(12) United States Patent
Laurie

(10) Patent No.: US 7,939,708 B2
(45) Date of Patent: May 10, 2011

(54) MAIZE GENOMIC MARKER SET

(75) Inventor: Cathy C. Laurie, Saratoga, CA (US)

(73) Assignee: Monsanto Technology LLC, St. Louis, MO (US)

( * ) Notice: Subject to any disclaimer, the term of this patent is extended or adjusted under 35 U.S.C. 154(b) by 1474 days.

(21) Appl. No.: 10/898,546

(22) Filed: Jul. 22, 2004

(65) Prior Publication Data

US 2007/0039065 A1     Feb. 15, 2007

(51) Int. Cl.
*A01H 1/04* (2006.01)
*A01H 1/00* (2006.01)
*A01H 1/02* (2006.01)

(52) U.S. Cl. .......................... 800/267; 800/260; 800/266

(58) Field of Classification Search .................. 800/260, 800/264, 266, 267, 275, 320.1, 800
See application file for complete search history.

(56) References Cited

OTHER PUBLICATIONS

Berke et al. 1995. Crop Sci. 35: 1542-1549.*

* cited by examiner

*Primary Examiner* — Medina A. Ibrahim
*Assistant Examiner* — Keith O. Robinson
(74) *Attorney, Agent, or Firm* — Thomas P. McBride

(57) ABSTRACT

Maize markers useful for genotyping and association studies, e.g. association with oil content QTLs in populations derived from the Illinois High Oil and Illinois Low Oil maize lines. Primers and hybridization probes for Taqman™ assays are provided for 488 SNP markers in 484 loci.

1 Claim, No Drawings

MAIZE GENOMIC MARKER SET

REFERENCE TO RELATED APPLICATIONS

This application claims priority under 35 U.S.C. 120 to U.S. application Ser. No. 10/806,075, filed Mar. 22, 2004, now U.S. Pat. No. 7,194,205 application Ser. No. 10/613,520, filed Jul. 2, 2003, now abandoned application Ser. No. 10/389,566, filed Mar. 14, 2003 now abandoned which claims priority under 35 U.S.C. 119(e) to U.S. Provisional Application 60/365,301 filed Mar. 15, 2002, 60/391,786 filed Jun. 26, 2002 and 60/392,018 filed Jun. 26, 2002, all of which are incorporated herein by reference in their entireties.

INCORPORATION OF SEQUENCE LISTING

Two copies and a computer readable form of the sequence listing, i.e. labeled "Copy 1 of Sequence Listing", "Copy 2 of Sequence Listing" and "Computer Readable Form of Sequence Listing", each on a separate CD-ROM containing the file named "52900H.ST25.txt", which is 788 kb (measured in MS-Windows) and was created on Jul. 22, 2004, are herein incorporated by reference.

INCORPORATION OF TABLES

Two copies of Table 1, labeled as "Copy 1 of Table 1" and "Copy 2 of Table 1", each on a separate CD-ROM containing the file named "Table 1.txt", which is 145 kb (measured in MS-Windows) and was created on Jul. 22, 2004, are herein incorporated by reference.

all of which are incorporated herein by reference. The highly conserved nature of DNA combined with the rare occurrences of stable polymorphisms provide genetic markers that are both predictable and discerning of different genotypes. Among the classes of existing genetic markers are a variety of polymorphisms indicating genetic variation including restriction-fragment-length polymorphisms (RFLPs), amplified fragment-length polymorphisms (AFLPs), simple sequence repeats (SSRs), single nucleotide polymorphisms (SNPs), and insertion/deletion polymorphisms (Indels). Because the number of genetic markers for a plant species is limited, the discovery of additional genetic markers associated with a trait will facilitate genotyping applications including marker-trait association studies, gene mapping, gene discovery, marker-assisted selection, and marker-assisted breeding. Evolving technologies make certain genetic markers more amenable for rapid, large scale use. For instance, technologies for SNP detection indicate that SNPs may be preferred genetic markers.

SUMMARY OF THE INVENTION

This invention provides maize polymorphic markers, more specifically SNP and Indel markers located in 484 polymorphic maize genomic DNA loci having DNA sequence of SEQ ID NO:1 through SEQ ID NO:484. Such markers are useful for discovery and isolation of genes, marker trait association, discovery of QTLs and molecular breeding. This invention also provides primers and probes useful in genotyping with the 488 specific markers within the 484 polymorphic loci.

TABLES

The patent contains table(s) that have been included at the end of the specification.

FIELD OF THE INVENTION

Disclosed herein are inventions in the field of plant molecular biology, plant genetics and plant breeding. More specifically disclosed are maize genetic markers, i.e. polymorphic DNA, which are useful for discovery and isolation of genes, marker trait association, discovery of QTLs and molecular breeding.

BACKGROUND OF THE INVENTION

Maize, Zea mays L., is one of the major crops grown worldwide as a primary source for animal feed, human food and industrial purposes. Maize plants with improved agronomic traits and maize seed with improved quality traits are desirable for the farmer, processor and consumer of maize and maize derived products. The ability to breed or develop transgenic plants with improved traits depends in part on identification of genes or QTLs associated with a trait. The unique maize sequences disclosed herein are useful as mapping tools to assist in plant breeding, in gene and QTL discovery, as markers in marker trait association and molecular breeding.

Polymorphisms are useful as genetic markers for genotyping applications in the agriculture field, e.g., in plant genetic studies and commercial breeding. See for instance U.S. Pat. Nos. 5,385,835; 5,492,547 and 5,981,832, the disclosures of This invention also provides methods of using markers in the 484 polymorphic loci for genotyping maize, e.g. in identifying genes and QTLs, molecular breeding, mapping DNA clones, and the like.

DETAILED DESCRIPTION OF PREFERRED EMBODIMENTS

The following definitions are used to described the markers and their uses.

An "allele" means an alternative sequence at a particular locus; the length of an allele can be as small as 1 nucleotide base but is typically larger. Allelic sequence can be amino acid sequence or nucleic acid sequence.

A "locus" is a short sequence that is usually unique and usually found at one particular location by a point of reference, e.g., a short DNA sequence that is a gene, or part of a gene or intergenic region. A locus of this invention can be a unique PCR product. The loci of this invention are polymorphic between certain individuals.

"Genotype" means the specification of an allelic composition at one or more loci within an individual organism. In the case of diploid organisms, there are two alleles at each locus; a diploid genotype is said to be homozygous when the alleles are the same, and heterozygous when the alleles are different.

"Phenotype" means the detectable characteristics of a cell or organism that are a manifestation of gene expression.

"Marker" means a polymorphic sequence. A "polymorphism" is a variation among individuals in sequence, particularly in DNA sequence. Useful polymorphisms include a single nucleotide polymorphisms (SNPs) and insertions or deletions in DNA sequence (Indels).

"Marker assay" means a method for detecting a polymorphism at a particular locus using a particular method, e.g., phenotype (such as seed color, flower color, or other visually detectable trait), restriction fragment length polymorphism (RFLP), single base extension, electrophoresis, sequence alignment, allelic specific oligonucleotide hybridization (ASO), RAPID, etc. Preferred marker assays include single base extension as disclosed in U.S. Pat. No. 6,013,431 and allelic discrimination where endonuclease activity releases a reporter dye from a hybridization probe as disclosed in U.S. Pat. No. 5,538,848, the disclosures of both of which are incorporated herein by reference.

"Linkage" refers to relative frequency at which types of gametes are produced in a cross. For example, if locus A has alleles "A" or "a" and locus B has alleles "B" or "b," a cross between parent I with AABB and parent II with aabb will produce four possible gametes where the haploid genotypes are segregated into AB, Ab, aB and ab. The null expectation is that there will be independent and equal segregation into each of the four possible genotypes, i.e., with no linkage, ¼ of the gametes will be of each genotype. Segregation of gametes into a genotypes differing from ¼ are attributed to linkage. Two loci are said to be "genetically linked" when they show this deviation from the expected equal frequency of ¼.

"Linkage disequilibrium" is defined in the context of the relative frequency of gamete types in a population of many individuals in a single generation. If the frequency of allele A is p, a is p', B is q and b is q', then the expected frequency (with no linkage disequilibrium) of genotype AB is pq, Ab is pq', aB is p'q and ab is p'q'. Any deviation from the expected frequency is called linkage disequilibrium.

"Quantitative Trait Locus (QTL)" means a locus that controls to some degree numerically representable traits that are usually continuously distributed.

"Haplotype" means the genotype for multiple loci or genetic markers in a haploid gamete. Generally these loci or markers reside within a relatively small and defined region of a chromosome. A preferred haplotype comprises the 10 cM region or the 5 cM region or the 2 cM region surrounding an informative marker having a significant association with oil.

"Hybridizing" means the capacity of two nucleic acid molecules or fragments thereof to form anti-parallel, double-stranded nucleotide structure. The nucleic acid molecules of this invention are capable of hybridizing to other nucleic acid molecules under certain circumstances. A nucleic acid molecule is said to be the "complement" of another nucleic acid molecule if the molecules exhibit "complete complementarity," i.e., each nucleotide in one sequence is complementary to its base pairing partner nucleotide in another sequence. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Nucleic acid molecules that hybridize to other nucleic acid molecules, e.g., at least under low stringency conditions are said to be "hybridizable cognates" of the other nucleic acid molecules. Conventional stringency conditions are described by Sambrook et al., *Molecular Cloning, A Laboratory Manual*, 2nd Ed., Cold Spring Harbor Press, Cold Spring Harbor, N.Y. (1989) and by Haymes et al., *Nucleic Acid Hybridization, A Practical Approach*, IRL Press, Washington, D.C. (1985), each of which is incorporated herein by reference. Departures from complete complementarity are therefore permissible, as long as such departures do not completely preclude the capacity of the molecules to form a double-stranded structure. Thus, in order for a nucleic acid molecule to serve as a primer or probe, it need only be sufficiently complementary in sequence to be able to form a stable double-stranded structure under the particular solvent and salt concentrations employed. Appropriate stringency conditions that promote DNA hybridization, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6, incorporated herein by reference. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

"Sequence identity" refers to the extent to which two optimally aligned polynucleotide or peptide sequences are invariant throughout a window of alignment of components, e.g., nucleotides or amino acids. An "identity fraction" for aligned segments of a test sequence and a reference sequence is the number of identical components that are shared by the two aligned sequences divided by the total number of components in reference sequence segment, i.e., the entire reference sequence or a smaller defined part of the reference sequence. "Percent identity" is the identity fraction times 100. Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and preferably by computerized implementations of these algorithms such as GAP, BESTFIT, FASTA, and TFASTA available as part of the GCG® Wisconsin Package® (Accelrys Inc. Burlington, Mass.). Polynucleotides of the present invention that are variants of the polynucleotides provided herein will generally demonstrate significant identity with the polynucleotides provided herein. Of particular interest are polynucleotide homologs having at least about 70% sequence identity, at least about 80% sequence identity, at least about 90% sequence identity, and more preferably even greater, such as 98% or 99% sequence identity with polynucleotide sequences described herein.

"Purified" refers to a nucleic acid molecule or polypeptide separated from substantially all other molecules normally associated with it in its native state. More preferably, a substantially purified molecule is the predominant species present in a preparation. A substantially purified molecule may be greater than 60% free or 75% free or 90% free or 95% free from the other molecules (exclusive of solvent) present in the natural mixture. The terms "isolated and purified" and "substantially purified" are not intended to encompass molecules present in their native state.

Characteristics of Maize Markers

The maize loci of this invention comprise a DNA sequence that comprises at least 20 consecutive nucleotides and includes or is adjacent to one or more polymorphisms identified in Table 1. Such maize loci have a nucleic acid sequence having at least 90% sequence identity or at least 95% or for some alleles at least 98% and in many cases at least 99% sequence identity, to the sequence of the same number of nucleotides in either strand of a segment of maize DNA that includes or is adjacent to the polymorphism. The nucleotide sequence of one strand of such a segment of maize DNA may be found in a polymorphic locus with a sequence in the group consisting of SEQ ID NO:1 through SEQ ID NO:186. It is understood by the very nature of polymorphisms that for at least some alleles there will be no identity to the polymorphism, per se. Thus, sequence identity can be determined for sequence that is exclusive of the polymorphism sequence. The polymorphisms in each locus are identified more particularly in Table 1.

For many genotyping applications it is useful to employ as markers polymorphisms from more than one locus. Thus, aspects of the invention use a collection of different loci. The number of loci in such a collection can vary but will be a finite number, e.g., as few as 2 or 5 or 10 or 25 loci or more, for instance up to 40 or 75 or 100 or more loci.

Another aspect of the invention provides nucleic acid molecules that are capable of hybridizing to the polymorphic maize loci of this invention, e.g. PCR primers and hybridization probes. In certain embodiments of the invention, e.g., which provide PCR primers, such molecules comprise at least 15 nucleotide bases. Molecules useful as primers can hybridize under high stringency conditions to one of the strands of a segment of DNA in a polymorphic locus of this invention. Primers for amplifying DNA are provided in pairs, i.e., a forward primer and a reverse primer. One primer will be complementary to one strand of DNA in the locus and the other primer will be complementary to the other strand of DNA in the locus, i.e., the sequence of a primer is at least 90% or at least 95% identical to a sequence of the same number of nucleotides in one of the strands. It is understood that such primers can hybridize to a sequence in the locus that is distant from the polymorphism, e.g., at least 5, 10, 20, 50 or up to about 100 nucleotide bases away from the polymorphism. Design of a primer of this invention will depend on factors well known in the art, e.g., avoidance of repetitive sequence.

Another aspect of the nucleic acid molecules of this invention are hybridization probes for polymorphism assays. In one aspect of the invention such probes are oligonucleotides comprising at least 12 nucleotide bases and a detectable label. The purpose of such a molecule is to hybridize, e.g., under high stringency conditions, to one strand of DNA in a segment of nucleotide bases that includes or is adjacent to the polymorphism of interest in an amplified part of a polymorphic locus. Such oligonucleotides are at least 90% or at least 95% identical to the sequence of a segment of the same number of nucleotides in one strand of maize DNA in a polymorphic locus. The detectable label can be a radioactive element or a dye. In preferred aspects of the invention, the hybridization probe further comprises a fluorescent label and a quencher, e.g., for use in hybridization probe assays of the type known as Taqman assays, available from Applied Biosystems of Foster City, Calif.

For assays where the molecule is designed to hybridize adjacent to a polymorphism that is detected by single base extension, e.g., of a labeled dideoxynucleotide, such molecules can comprise at least 15 or at least 16 or 17 nucleotide bases in a sequence that is at least 90% or at least 95% identical to a sequence of the same number of consecutive nucleotides in either strand of a segment of polymorphic maize DNA. Oligonucleotides for single base extension assays are available from Orchid Biosystems.

Such primer and probe molecules are generally provided in groups of two primers and one or more probes for use in genotyping assays. Moreover, it is often desirable to conduct a plurality of genotyping assays for a plurality of polymorphisms. Thus, this invention also provides collections of nucleic acid molecules, e.g., in sets that characterize a plurality of polymorphisms.

Detecting Polymorphisms

Polymorphisms in DNA sequences can be detected by a variety of effective methods well known in the art including those methods disclosed in U.S. Pat. Nos. 5,468,613 and 5,217,863 by hybridization to allele-specific oligonucleotides; in U.S. Pat. Nos. 5,468,613 and 5,800,944 by probe ligation; in U.S. Pat. No. 5,616,464 by probe linking; and in U.S. Pat. Nos. 6,004,744; 6,013,431; 5,595,890; 5,762,876; and 5,945,283 by labeled base extension, all of which are incorporated herein by reference.

In another preferred method for detecting polymorphisms, SNPs and Indels can be detected by methods disclosed in U.S. Pat. Nos. 5,210,015; 5,876,930; and 6,030,787 in which an oligonucleotide probe having a 5'fluorescent reporter dye and a 3'quencher dye covalently linked to the 5' and 3' ends of the probe. When the probe is intact, the proximity of the reporter dye to the quencher dye results in the suppression of the reporter fluorescence, e.g., by Forster-type energy transfer. During PCR forward and reverse primers hybridize to a specific sequence of the target DNA flanking a polymorphism. The hybridization probe hybridizes to polymorphism-containing sequence within the amplified PCR product. In the subsequent PCR cycle DNA polymerase with 5'→3' exonuclease activity cleaves the probe and separates the reporter dye from the quencher dye resulting in increased fluorescence of the reporter. A useful assay is available from AB Biosystems as the Taqman® assay, which employs four synthetic oligonucleotides in a single reaction that concurrently amplifies the maize genomic DNA, discriminates between the alleles present, and directly provides a signal for discrimination and detection. Two of the four oligonucleotides serve as PCR primers and generate a PCR product encompassing the polymorphism to be detected. Two others are allele-specific fluorescence-resonance-energy-transfer (FRET) probes. FRET probes incorporate a fluorophore and a quencher molecule in close proximity so that the fluorescence of the fluorophore is quenched. The signal from a FRET probe is generated by degradation of the FRET oligonucleotide, so that the fluorophore is released from proximity to the quencher, and is thus able to emit light when excited at an appropriate wavelength. In the assay, two FRET probes bearing different fluorescent reporter dyes are used, where a unique dye is incorporated into an oligonucleotide that can anneal with high specificity to only one of the two alleles. Useful reporter dyes include 6-carboxy-4,7,2',7'-tetrachlorofluorecein (TET), VIC (a dye from Applied Biosystems Foster City, Calif.), and 6-carboxyfluorescein phosphoramidite (FAM). A useful quencher is 6-carboxy-N,N,N',N'-tetramethylrhodamine (TAMRA). Additionally, the 3'end of each FRET probe is chemically blocked so that it cannot act as a PCR primer. During the assay, maize genomic DNA is added to a buffer containing the two PCR primers and two FRET probes. Also present is a third fluorophore used as a passive reference, e.g., rhodamine X (ROX), to aid in later normalization of the relevant fluorescence values (correcting for volumetric errors in reaction assembly). Amplification of the genomic DNA is initiated. During each cycle of the PCR, the FRET probes anneal in an allele-specific manner to the template DNA molecules. Annealed (but not non-annealed) FRET probes are degraded by TAQ DNA polymerase as the enzyme encounters the 5' end of the annealed probe, thus releasing the fluorophore from proximity to its quencher. Following the PCR reaction, the fluorescence of each of the two fluorescers, as well as that of the passive reference, is determined fluorometrically. The normalized intensity of fluorescence for each of the two dyes will be proportional to the amounts of each allele initially present in the sample, and thus the genotype of the sample can be inferred.

To design primers and probes for the assay the locus sequence is first masked to prevent design of any of the three primers to sites that match known maize repetitive elements (e.g., transposons) or are of very low sequence complexity (di- or tri-nucleotide repeat sequences). Design of primers to such repetitive elements will result in assays of low specificity, through amplification of multiple loci or annealing of the FRET probes to multiple sites.

PCR primers are designed (a) to have a length in the size range of 18 to 25 bases and matching sequences in the polymorphic locus, (b) to have a calculated melting temperature in the range of 57° C. to 60° C., e.g., corresponding to an optimal PCR annealing temperature of 52° C. to 55° C., (c) to produce a product that includes the polymorphic site and has a length in the size range of 75 to 250 base pairs. The PCR primers are preferably located on the locus so that the polymorphic site is at least one base away from the 3' end of each PCR primer. The PCR primers must not contain regions that are extensively self- or inter-complementary.

FRET probes are designed to span the sequence of the polymorphic site, preferably with the polymorphism located in the 3' most ⅔ of the oligonucleotide. In the preferred embodiment, the FRET probes will have incorporated at their 3'end a chemical moiety that, when the probe is annealed to the template DNA, binds to the minor groove of the DNA, thus enhancing the stability of the probe-template complex. The probes should have a length in the range of 12 to 17 bases and, with the 3'MGB, have a calculated melting temperature of 5° C. to 7° C. above that of the PCR primers. Probe design is disclosed in U.S. Pat. Nos. 5,538,848; 6,084,102; and 6,127,121.

Use of Polymorphisms to Establish Marker/Trait Associations

The polymorphisms in the loci of this invention can be used in marker/trait associations that are inferred from statistical analysis of genotypes and phenotypes of the members of a population. These members may be individual organisms, e.g., maize, families of closely related individuals, inbred lines, dihaploids or other groups of closely related individuals. Such maize groups are referred to as "lines", indicating line of descent. The population may be descended from a single cross between two individuals or two lines (e.g., a mapping population) or it may consist of individuals with many lines of descent. Each individual or line is characterized by a single or average trait phenotype and by the genotypes at one or more marker loci.

Several types of statistical analysis can be used to infer marker/trait association from the phenotype/genotype data, but a basic idea is to detect markers, i.e., polymorphisms, for which alternative genotypes have significantly different average phenotypes. For example, if a given marker locus A has three alternative genotypes (AA, Aa and aa), and if those three classes of individuals have significantly different phenotypes, then one infers that locus A is associated with the trait. The significance of differences in phenotype may be tested by several types of standard statistical tests such as linear regression of marker genotypes on phenotype or analysis of variance (ANOVA). Commercially available, statistical software packages commonly used to do this type of analysis include SAS Enterprise Miner (SAS Institute Inc., Cary, N.C.) and Splus (Insightful Corporation. Cambridge, Mass.).

Often the goal of an association study is not simply to detect marker/trait associations, but to estimate the location of genes affecting the trait directly (i.e., QTLs) relative to the marker locations. In a simple approach to this goal, one makes a comparison among marker loci of the magnitude of difference among alternative genotypes or the level of significance of that difference. Trait genes are inferred to be located nearest the marker(s) that have the greatest associated genotypic difference. In a more complex analysis, such as interval mapping (Lander and Botstein, *Genetics* 121:185-199, 1989), each of many positions along the genetic map (say at 1 cM intervals) is tested for the likelihood that a QTL is located at that position. The genotype/phenotype data are used to calculate for each test position a LOD score (log of likelihood ratio). When the LOD score exceeds a critical threshold value, there is significant evidence for the location of a QTL at that position on the genetic map (which will fall between two particular marker loci).

1. Linkage Disequilibrium Mapping and Association Studies

Another approach to determining trait gene location is to analyze trait-marker associations in a population within which individuals differ at both trait and marker loci. Certain marker alleles may be associated with certain trait locus alleles in this population due to population genetic process such as the unique origin of mutations, founder events, random drift and population structure. This association is referred to as linkage disequilibrium. In linkage disequilibrium mapping, one compares the trait values of individuals with different genotypes at a marker locus. Typically, a significant trait difference indicates close proximity between marker locus and one or more trait loci. If the marker density is appropriately high and the linkage disequilibrium occurs only between very closely linked sites on a chromosome, the location of trait loci can be very precise.

A specific type of linkage disequilibrium mapping is known as association studies. This approach makes use of markers within candidate genes, which are genes that are thought to be functionally involved in development of the trait because of information such as biochemistry, physiology, transcriptional profiling and reverse genetic experiments in model organisms. In association studies, markers within candidate genes are tested for association with trait variation. If linkage disequilibrium in the study population is restricted to very closely linked sites (i.e., within a gene or between adjacent genes), a positive association provides nearly conclusive evidence that the candidate gene is a trait gene.

2. Positional Cloning and Transgenic Applications

Traditional linkage mapping typically localizes a trait gene to an interval between two genetic markers (referred to as flanking markers). When this interval is relatively small (say less than 1 Mb), it becomes feasible to precisely identify the trait gene by a positional cloning procedure. A high marker density is required to narrow down the interval length sufficiently. This procedure requires a library of large insert genomic clones (such as a BAC library), where the inserts are pieces (usually 100-150 kb in length) of genomic DNA from the species of interest. The library is screened by probe hybridization or PCR to identify clones that contain the flanking marker sequences. Then a series of partially overlapping clones that connects the two flanking clones (a "contig") is built up through physical mapping procedures. These procedures include fingerprinting, STS content mapping and sequence-tagged connector methodologies. Once the physical contig is constructed and sequenced, the sequence is searched for all transcriptional units. The transcriptional unit that corresponds to the trait gene can be determined by comparing sequences between mutant and wild type strains, by additional fine-scale genetic mapping, and/or by functional testing through plant transformation. Trait genes identified in this way become leads for transgenic product development. Similarly, trait genes identified by association studies with candidate genes become leads for transgenic product development.

3. Marker-Aided Breeding and Marker-Assisted Selection

When a trait gene has been localized in the vicinity of genetic markers, those markers can be used to select for improved values of the trait without the need for phenotypic analysis at each cycle of selection. In marker-aided breeding and marker-assisted selection, associations between trait genes and markers are established initially through genetic mapping analysis (as in M.1 or M.2). In the same process, one determines which marker alleles are linked to favorable trait gene alleles. Subsequently, marker alleles associated with favorable trait gene alleles are selected in the population. This procedure will improve the value of the trait provided that there is sufficiently close linkage between markers and trait genes. The degree of linkage required depends upon the number of generations of selection because, at each generation, there is opportunity for breakdown of the association through recombination.

4. Prediction of Crosses for New Inbred Line Development

The associations between specific marker alleles and favorable trait gene alleles also can be used to predict what types of progeny may segregate from a given cross. This prediction may allow selection of appropriate parents to generation populations from which new combinations of favorable trait gene alleles are assembled to produce a new inbred line. For example, if line A has marker alleles previously known to be associated with favorable trait alleles at loci 1, 20 and 31, while line B has marker alleles associated with favorable effects at loci 15, 27 and 29, then a new line could be developed by crossing A×B and selecting progeny that have favorable alleles at all 6 trait loci.

5. Hybrid Prediction

Commercial corn seed is produced by making hybrids between two elite inbred lines that belong to different "heterotic groups". These groups are sufficiently distinct genetically that hybrids between them show high levels of heterosis or hybrid vigor (i.e., increased performance relative to the parental lines). By analyzing the marker constitution of good hybrids, one can identify sets of alleles at different loci in both male and female lines that combine well to produce heterosis. Understanding these patterns, and knowing the marker constitution of different inbred lines, can allow prediction of the level of heterosis between different pairs of lines. These predictions can narrow down the possibilities of which line(s) of opposite heterotic group should be used to test the performance of a new inbred line.

6. Identity by Descent

One theory of heterosis predicts that regions of identity by descent (IBD) between the male and female lines used to produce a hybrid will reduce hybrid performance. Identity by descent can be inferred from patterns of marker alleles in different lines. An identical string of markers at a series of adjacent loci may be considered identical by descent if it is unlikely to occur independently by chance. Analysis of marker fingerprints in male and female lines can identify regions of IBD. Knowledge of these regions can inform the choice of hybrid parents, because avoiding IBD in hybrids is likely to improve performance. This knowledge may also inform breeding programs in that crosses could be designed to produce pairs of inbred lines (one male and one female) that show little or no IBD.

A fingerprint of an inbred line is the combination of alleles at a set of marker loci. High density fingerprints can be used to establish and trace the identity of germplasm, which has utility in germplasm ownership protection.

Genetic markers are used to accelerate introgression of transgenes into new genetic backgrounds (i.e., into a diverse range of germplasm). Simple introgression involves crossing a transgenic line to an elite inbred line and then backcrossing the hybrid repeatedly to the elite (recurrent) parent, while selecting for maintenance of the transgene. Over multiple backcross generations, the genetic background of the original transgenic line is replaced gradually by the genetic background of the elite inbred through recombination and segregation. This process can be accelerated by selection on marker alleles that derive from the recurrent parent.

Use of Polymorphism Assay for Mapping a Library of DNA Clones

The polymorphisms and loci of this invention are useful for identifying and mapping DNA sequence of QTLs and genes linked to the polymorphisms. For instance, BAC or YAC clone libraries can be queried using polymorphisms linked to a trait to find a clone containing specific QTLs and genes associated with the trait. For instance, QTLs and genes in a plurality, e.g., hundreds or thousands, of large, multi-gene sequences can be identified by hybridization with an oligonucleotide probe that hybridizes to a mapped and/or linked polymorphism. Such hybridization screening can be improved by providing clone sequence in a high density array. The screening method is more preferably enhanced by employing a pooling strategy to significantly reduce the number of hybridizations required to identify a clone containing the polymorphism. When the polymorphisms are mapped, the screening effectively maps the clones.

For instance, in a case where thousands of clones are arranged in a defined array, e.g., in 96-well plates, the plates can be arbitrarily arranged in three-dimensionally, arrayed stacks of wells each comprising a unique DNA clone. The wells in each stack can be represented as discrete elements in a three dimensional array of rows, columns and plates. In one aspect of the invention the number of stacks and plates in a stack are about equal to minimize the number of assays. The stacks of plates allow the construction of pools of cloned DNA.

For a three-dimensionally arrayed stack, pools of cloned DNA can be created for (a) all of the elements in each row, (b) all of the elements of each column, and (c) all of the elements of each plate. Hybridization screening of the pools with an oligonucleotide probe that hybridizes to a polymorphism unique to one of the clones will provide a positive indication for one column pool, one row pool and one plate pool, thereby indicating the well element containing the target clone.

In the case of multiple stacks, additional pools of all of the clone DNA in each stack allows indication of the stack having the row-column-plate coordinates of the target clone. For instance, a 4608 clone set can be disposed in 48 96-well plates. The 48 plates can be arranged in 8 sets of 6-plate stacks providing 6×12×8 three-dimensional arrays of elements, i.e., each stack comprises 6 stacks of 8 rows and 12 columns. For the entire clone set there are 36 pools, i.e., 6 stack pools, 8 row pools, 12 column pools and 8 stack pools. Thus, a maximum of 36 hybridization reactions is required to find the clone harboring QTLs or genes associated or linked to each mapped polymorphism.

Once a clone is identified, genes within that clone can be tested for whether they affect the trait by analysis of recombinants in a mapping population, further linkage disequilibrium analysis, and ultimately transgenic testing. Additional genes can be identified by finding additional clones overlapping the one containing the original polymorphism through contig building, as described above.

Breeding Plants of the Invention

In addition to direct transformation of a particular plant genotype with a construct prepared according to the current invention, transgenic plants may be made by crossing a plant having a construct of the invention to a second plant lacking the construct. For example, a selected coding region operably linked to a promoter can be introduced into a particular plant variety by crossing, without the need for ever directly transforming a plant of that given variety. Therefore, the current invention not only encompasses a plant directly regenerated from cells that have been transformed in accordance with the current invention, but also the progeny of such plants. As used herein the term "progeny" denotes the offspring of any generation of a parent plant prepared in accordance with the instant invention, wherein the progeny comprises a construct prepared in accordance with the invention. "Crossing" a plant to provide a plant line having one or more added transgenes relative to a starting plant line, as disclosed herein, is defined as the techniques that result in a transgene of the invention being introduced into a plant line by crossing a starting line with a donor plant line that comprises a transgene of the invention. To achieve this one could, for example, perform the following steps:

(a) plant seeds of the first (starting line) and second (donor plant line that comprises a transgene of the invention) parent plants;
(b) grow the seeds of the first and second parent plants into plants that bear flowers;
(c) pollinate a flower from the first parent plant with pollen from the second parent plant; and
(d) harvest seeds produced on the parent plant bearing the fertilized flower.

Backcrossing is herein defined as the process including the steps of:

(a) crossing a plant of a first genotype containing a desired gene, DNA sequence or element to a plant of a second genotype lacking the desired gene, DNA sequence or element;
(b) selecting one or more progeny plants containing the desired gene, DNA sequence or element;
(c) crossing the progeny plant to a plant of the second genotype; and
(d) repeating steps (b) and (c) for the purpose of transferring the desired gene, DNA sequence or element from a plant of a first genotype to a plant of a second genotype.

Plant Breeding

Introgression of a DNA element into a plant genotype is defined as the result of the process of backcross conversion. A plant genotype into which a DNA sequence has been introgressed may be referred to as a backcross converted genotype, line, inbred, or hybrid. Similarly a plant genotype lacking the desired DNA sequence may be referred to as an unconverted genotype, line, inbred, or hybrid.

Backcrossing can be used to improve a starting plant. Backcrossing transfers a specific desirable trait from one source to an inbred or other plant that lacks that trait. This can be accomplished, for example, by first crossing a superior inbred (A) (recurrent parent) to a donor inbred (non-recurrent parent), which carries the appropriate gene(s) for the trait in question, for example, a construct prepared in accordance with the current invention. The progeny of this cross first are selected in the resultant progeny for the desired trait to be transferred from the non-recurrent parent, then the selected progeny are mated back to the superior recurrent parent (A). After five or more backcross generations with selection for the desired trait, the progeny are hemizygous for loci controlling the characteristic being transferred but are like the superior parent for most or almost all other genes. The last backcross generation would be selfed to give progeny that are pure breeding for the gene(s) being transferred, i.e., one or more transformation events.

Therefore, through a series a breeding manipulations, a selected transgene may be moved from one line into an entirely different line without the need for further recombinant manipulation. Transgenes are valuable in that they typically behave genetically as any other gene and can be manipulated by breeding techniques in a manner identical to any other corn gene. Therefore, one may produce inbred plants that are true breeding for one or more transgenes. By crossing different inbred plants, one may produce a large number of different hybrids with different combinations of transgenes. In this way, plants may be produced that have the desirable agronomic properties frequently associated with hybrids ("hybrid vigor"), as well as the desirable characteristics imparted by one or more transgene(s).

It is desirable to introgress the genes of the present invention into maize hybrids for characterization of the phenotype conferred by each gene in a transformed plant. The host genotype into which the transgene was introduced, preferably LH59, is an elite inbred and therefore only limited breeding is necessary in order to produce high yielding maize hybrids. The transformed plant, regenerated from callus is crossed, to the same genotype, e.g., LH59. The progeny are self-pollinated twice, and plants homozygous for the transgene are identified. Homozygous transgenic plants are crossed to a testcross parent in order to produce hybrids. The test cross parent is an inbred belonging to a heterotic group that is different from that of the transgenic parent and for which it is known that high yielding hybrids can be generated, for example hybrids are produced from crosses of LH59 to either LH195 or LH200.

The following examples illustrate the identification of polymorphic markers useful for mapping and isolating genes of this invention and as markers of QTLs and genes associated with an oil-related trait. Other examples illustrate the identification of oil-related genes and partial genes. Still other examples illustrate methods for inserting genes of this invention into a plant expression vector, i.e., operably linked to a promoter and other regulatory elements, to confer an oil-related trait to a transgenic plant.

Example 1

This example illustrates the identification of polymorphic maize markers of this invention.

A set of more than 800 candidate oil genes was identified (a) as homologs of plant genes that are believed to be in an oil-related metabolic pathway of a model plant such as *Arabidopsis thaliana*; (b) by comparing transcription profiling results for high oil and low oil maize lines; and (c) by subtractive hybridization between endosperm tissues of high oil and low oil lines. The sequences of the candidate oil genes were queried against a proprietary collection of maize genes and partial maize genes, e.g., genomic sequence or ESTs, to identify a set of DNA sequences for candidate maize markers.

Maize polymorphisms were identified by comparing alignments of DNA sequences from separate maize lines. Candidate polymorphisms were qualified by the following parameters:

The minimum length of sequence for a synthetic reference sequence is 200 bases.

The percentage identity of observed bases in a region of 15 bases on each side of a candidate SNP, is 75%.

The minimum BLAST quality in each of the various sequences at a polymorphism site is 35.

The minimum BLAST quality in a region of 15 bases on each side of the polymorphism site is 20.

The SNP and Indel polymorphisms in each locus were qualified for detection by development of an assay, e.g., Taqman® assay (Applied Biosystems, Foster City, Calif.). Assay qualified polymorphisms are evaluated for oil informativeness by comparing allelic frequencies in the two parental lines of an association study population. The parent lines were an oil rich maize line and an oil poor maize line, i.e., the University of Illinois High Oil and Low Oil maize lines as described by Dudley and Lambert (1992, Maydica 37: 81-87). Informativeness is reported as an allelic frequency difference between parental populations, i.e. the high oil line and the low oil line. When one of the parents, e.g., the high oil line, is fixed, its allelic frequency is 1. Markers were qualified if they had an allelic frequency difference of at least 0.6. If the marker was fixed on either parent with a frequency of 0 or 1, a marker could be selected at a lower allelic frequency difference of at least 0.4. The informative markers were viewed on a genetic map to identify marker-deficient regions of chromosomes. Markers with lower allelic frequency difference, e.g., as low as 0.15, were selected to fill in the marker-deficient regions of chromosomes.

DNA amplicons of 484 polymorphic maize genomic DNA loci of this invention are provided in the sequence listing as SEQ ID NO:1 through SEQ ID NO:484. Table 1 provides a description of polymorphisms in the 484 DNA amplicons. Particular aspects of the markers are identified in Table 1 by reference to:

SEQ_NUM, which refers to the sequence number of a nucleic acid sequence in the sequence listing, e.g. SEQ ID NO:1; and SEQ_ID, which refers to an arbitrary identifying name for an amplicon of a polymorphic locus, e.g. "Amplicon25";

MUTATION_ID, which refers to one or more arbitrary identifying names for each polymorphism, e.g. "91";

START_POS which refers to the position in the nucleotide sequence of the polymorphic maize DNA locus where the polymorphism begins, e.g. 110;

END_POS which refers to the position in the nucleotide sequence of the polymorphic maize DNA locus where the polymorphism ends; for SNPs the START_POS and END_POS are common;

TYPE which refers to the identification of the polymorphism as an SNP or IND (Indel);

ALLELEn and STRAINn which refer to the nucleotide sequence of a polymorphism in a specific allelic maize variety, e.g. "C", "T", and when strains are indicated "mo17" and "b73";

Taqman® assays for 488 markers in the 484 polymorphic loci (4 loci are represented by marker assays for 2 separate polymorphisms) are characterized by four separate DNA molecules, i.e. a forward PCR primer, a reverse PCR primer, a VIC-labeled hybridization probe and a FAM-labeled hybridization probe, identified by SEQ ID NO:485 through SEQ ID NO:2436. The primers and probes for each of the 488 markers are more particularly identified in Table 2 by reference to:

Chromosome which refers to one of ten maize chromosomes.

Position which refers to distance to the marker measured in cM from the 5' end of the chromosome.

Marker which corresponds to the MUTATION_ID in the amplicon of SEQ_NUM (1-484).

Forward designates the number in the Sequence Listing for the DNA sequence of the forward primer.

Reverse designates the number in the Sequence Listing for the DNA sequence of the reverse primer.

FAM designates the number in the Sequence Listing for the FAM-labeled hybridization probe.

VIC designates the number in the Sequence Listing for the VIC-labeled hybridization probe.

TABLE 2

| Chromosome | Position | Marker | SEQ_NUM | Forward | Reverse | FAM | VIC |
|---|---|---|---|---|---|---|---|
| 1 | 3.7 | 111829 | 406 | 2121 | 2122 | 2123 | 2124 |
| 1 | 5.6 | 147181 | 442 | 2265 | 2266 | 2267 | 2268 |
| 1 | 14.9 | 36199 | 222 | 1381 | 1382 | 1383 | 1384 |
| 1 | 17.3 | 25418 | 149 | 1081 | 1082 | 1083 | 1084 |
| 1 | 22.4 | 28164 | 155 | 1105 | 1106 | 1107 | 1108 |
| 1 | 25.1 | 43230 | 269 | 1573 | 1574 | 1575 | 1576 |
| 1 | 30.4 | 2847 | 11 | 525 | 526 | 527 | 528 |
| 1 | 30.4 | 144506 | 424 | 2193 | 2194 | 2195 | 2196 |
| 1 | 40.2 | 36685 | 228 | 1405 | 1406 | 1407 | 1408 |
| 1 | 44 | 104827 | 336 | 1841 | 1842 | 1843 | 1844 |
| 1 | 45 | 151360 | 459 | 2333 | 2334 | 2335 | 2336 |
| 1 | 46.8 | 35417 | 216 | 1353 | 1354 | 1355 | 1356 |
| 1 | 46.8 | 37716 | 236 | 1437 | 1438 | 1439 | 1440 |
| 1 | 47.1 | 4409 | 25 | 585 | 586 | 587 | 588 |
| 1 | 52.2 | 42173 | 266 | 1561 | 1562 | 1563 | 1564 |
| 1 | 58.4 | 116 | 2 | 489 | 490 | 491 | 492 |
| 1 | 58.4 | 9159 | 52 | 693 | 694 | 695 | 696 |
| 1 | 60.3 | 143100 | 412 | 2145 | 2146 | 2147 | 2148 |
| 1 | 60.5 | 16876 | 113 | 937 | 938 | 939 | 940 |
| 1 | 60.6 | 33819 | 206 | 1313 | 1314 | 1315 | 1316 |
| 1 | 60.6 | 40124 | 254 | 1513 | 1514 | 1515 | 1516 |
| 1 | 60.6 | 40189 | 255 | 1517 | 1518 | 1519 | 1520 |
| 1 | 62.5 | 9449 | 57 | 713 | 714 | 715 | 716 |
| 1 | 62.5 | 33372 | 203 | 1301 | 1302 | 1303 | 1304 |
| 1 | 68.8 | 148156 | 451 | 2301 | 2302 | 2303 | 2304 |
| 1 | 83.2 | 25863 | 147 | 1073 | 1074 | 1075 | 1076 |

TABLE 2-continued

| Chromosome | Position | Marker | SEQ_NUM | Forward | Reverse | FAM | VIC |
|---|---|---|---|---|---|---|---|
| 1 | 83.2 | 34205 | 207 | 1317 | 1318 | 1319 | 1320 |
| 1 | 83.2 | 43789 | 271 | 1581 | 1582 | 1583 | 1584 |
| 1 | 83.7 | 11522 | 74 | 781 | 782 | 783 | 784 |
| 1 | 83.7 | 106244 | 348 | 1889 | 1890 | 1891 | 1892 |
| 1 | 85.6 | 144090 | 423 | 2189 | 2190 | 2191 | 2192 |
| 1 | 85.9 | 5215 | 35 | 625 | 626 | 627 | 628 |
| 1 | 85.9 | 27375 | 152 | 1093 | 1094 | 1095 | 1096 |
| 1 | 85.9 | 69188 | 301 | 1701 | 1702 | 1703 | 1704 |
| 1 | 86.3 | 8984 | 49 | 681 | 682 | 683 | 684 |
| 1 | 86.3 | 36286 | 223 | 1385 | 1386 | 1387 | 1388 |
| 1 | 86.6 | 148194 | 452 | 2305 | 2306 | 2307 | 2308 |
| 1 | 88.8 | 29829 | 170 | 1165 | 1166 | 1167 | 1168 |
| 1 | 88.8 | 37068 | 231 | 1417 | 1418 | 1419 | 1420 |
| 1 | 88.8 | 68435 | 297 | 1685 | 1686 | 1687 | 1688 |
| 1 | 89.6 | 111365 | 399 | 2093 | 2094 | 2095 | 2096 |
| 1 | 90.5 | 60430 | 293 | 1669 | 1670 | 1671 | 1672 |
| 1 | 90.5 | 111828 | 405 | 2117 | 2118 | 2119 | 2120 |
| 1 | 91 | 113263 | 410 | 2137 | 2138 | 2139 | 2140 |
| 1 | 91.8 | 104474 | 333 | 1829 | 1830 | 1831 | 1832 |
| 1 | 92.3 | 145573 | 433 | 2229 | 2230 | 2231 | 2232 |
| 1 | 95 | 39351 | 247 | 1485 | 1486 | 1487 | 1488 |
| 1 | 96.4 | 107701 | 364 | 1953 | 1954 | 1955 | 1956 |
| 1 | 96.9 | 36448 | 225 | 1393 | 1394 | 1395 | 1396 |
| 1 | 99 | 40655 | 261 | 1541 | 1542 | 1543 | 1544 |
| 1 | 99 | 107077 | 357 | 1925 | 1926 | 1927 | 1928 |
| 1 | 103.3 | 8719 | 40 | 645 | 646 | 647 | 648 |
| 1 | 116.3 | 40338 | 257 | 1525 | 1526 | 1527 | 1528 |
| 1 | 116.3 | 54410 | 284 | 1633 | 1634 | 1635 | 1636 |
| 1 | 121.1 | 107621 | 362 | 1945 | 1946 | 1947 | 1948 |
| 1 | 121.5 | 16755 | 111 | 929 | 930 | 931 | 932 |
| 1 | 121.5 | 36863 | 230 | 1413 | 1414 | 1415 | 1416 |
| 1 | 122.1 | 41280 | 263 | 1549 | 1550 | 1551 | 1552 |
| 1 | 123.3 | 109328 | 379 | 2013 | 2014 | 2015 | 2016 |
| 1 | 124.6 | 33373 | 204 | 1305 | 1306 | 1307 | 1308 |
| 1 | 127.6 | 105648 | 346 | 1881 | 1882 | 1883 | 1884 |
| 1 | 129.5 | 4453 | 28 | 597 | 598 | 599 | 600 |
| 1 | 129.5 | 9626 | 64 | 741 | 742 | 743 | 744 |
| 1 | 129.5 | 37689 | 235 | 1433 | 1434 | 1435 | 1436 |
| 1 | 130.3 | 69565 | 302 | 1705 | 1706 | 1707 | 1708 |
| 1 | 132.1 | 34903 | 209 | 1325 | 1326 | 1327 | 1328 |
| 1 | 133.9 | 16724 | 102 | 893 | 894 | 895 | 896 |
| 1 | 138.5 | 12824 | 79 | 801 | 802 | 803 | 804 |
| 1 | 139.2 | 38701 | 241 | 1461 | 1462 | 1463 | 1464 |
| 1 | 140.8 | 5098 | 33 | 617 | 618 | 619 | 620 |
| 1 | 153.7 | 31993 | 191 | 1253 | 1254 | 1255 | 1256 |
| 1 | 156.7 | 8982 | 48 | 677 | 678 | 679 | 680 |
| 1 | 159.7 | 39502 | 248 | 1489 | 1490 | 1491 | 1492 |
| 1 | 160.4 | 148362 | 455 | 2317 | 2318 | 2319 | 2320 |
| 1 | 164.2 | 39896 | 252 | 1505 | 1506 | 1507 | 1508 |
| 1 | 165.6 | 108862 | 376 | 2001 | 2002 | 2003 | 2004 |
| 1 | 168.3 | 9701 | 67 | 753 | 754 | 755 | 756 |
| 1 | 178.6 | 151382 | 457 | 2325 | 2326 | 2327 | 2328 |
| 1 | 179.8 | 32253 | 198 | 1281 | 1282 | 1283 | 1284 |
| 1 | 194.2 | 13490 | 81 | 809 | 810 | 811 | 812 |
| 1 | 200.3 | 30840 | 181 | 1213 | 1214 | 1215 | 1216 |
| 1 | 207 | 16137 | 98 | 877 | 878 | 879 | 880 |
| 2 | 5.8 | 9867 | 71 | 769 | 770 | 771 | 772 |
| 2 | 5.8 | 31064 | 183 | 1221 | 1222 | 1223 | 1224 |
| 2 | 12.9 | 104447 | 332 | 1825 | 1826 | 1827 | 1828 |
| 2 | 14.1 | 39289 | 246 | 1481 | 1482 | 1483 | 1484 |
| 2 | 17.5 | 106678 | 351 | 1901 | 1902 | 1903 | 1904 |
| 2 | 19.5 | 82235 | 325 | 1797 | 1798 | 1799 | 1800 |
| 2 | 30.1 | 106842 | 353 | 1909 | 1910 | 1911 | 1912 |
| 2 | 32.8 | 2945 | 12 | 529 | 530 | 531 | 532 |
| 2 | 32.8 | 16074 | 97 | 873 | 874 | 875 | 876 |
| 2 | 33.9 | 80031 | 321 | 1781 | 1782 | 1783 | 1784 |
| 2 | 35.9 | 13691 | 89 | 841 | 842 | 843 | 844 |
| 2 | 35.9 | 50315 | 277 | 1605 | 1606 | 1607 | 1608 |
| 2 | 38.3 | 9706 | 68 | 757 | 758 | 759 | 760 |
| 2 | 42.4 | 32016 | 192 | 1257 | 1258 | 1259 | 1260 |
| 2 | 62.2 | 80704 | 323 | 1789 | 1790 | 1791 | 1792 |
| 2 | 70.4 | 9364 | 56 | 709 | 710 | 711 | 712 |
| 2 | 74.8 | 9623 | 63 | 737 | 738 | 739 | 740 |
| 2 | 75.6 | 40931 | 262 | 1545 | 1546 | 1547 | 1548 |
| 2 | 76.2 | 36323 | 224 | 1389 | 1390 | 1391 | 1392 |
| 2 | 76.2 | 104946 | 340 | 1857 | 1858 | 1859 | 1860 |
| 2 | 77.4 | 111617 | 403 | 2109 | 2110 | 2111 | 2112 |
| 2 | 78.2 | 11466 | 73 | 777 | 778 | 779 | 780 |

TABLE 2-continued

| Chromosome | Position | Marker | SEQ_NUM | Forward | Reverse | FAM | VIC |
|---|---|---|---|---|---|---|---|
| 2 | 78.2 | 79073 | 315 | 1757 | 1758 | 1759 | 1760 |
| 2 | 78.2 | 108493 | 374 | 1993 | 1994 | 1995 | 1996 |
| 2 | 87.3 | 23442 | 143 | 1057 | 1058 | 1059 | 1060 |
| 2 | 87.5 | 107911 | 368 | 1969 | 1970 | 1971 | 1972 |
| 2 | 92.5 | 551 | 4 | 497 | 498 | 499 | 500 |
| 2 | 92.5 | 3177 | 14 | 537 | 538 | 539 | 540 |
| 2 | 92.5 | 53097 | 282 | 1625 | 1626 | 1627 | 1628 |
| 2 | 92.9 | 366 | 3 | 493 | 494 | 495 | 496 |
| 2 | 92.9 | 84829 | 330 | 1817 | 1818 | 1819 | 1820 |
| 2 | 99.7 | 151288 | 458 | 2329 | 2330 | 2331 | 2332 |
| 2 | 104.8 | 82458 | 327 | 1805 | 1806 | 1807 | 1808 |
| 2 | 106 | 111475 | 402 | 2105 | 2106 | 2107 | 2108 |
| 2 | 106.2 | 108013 | 371 | 1981 | 1982 | 1983 | 1984 |
| 2 | 107.6 | 2307 | 8 | 513 | 514 | 515 | 516 |
| 2 | 114.9 | 22775 | 135 | 1025 | 1026 | 1027 | 1028 |
| 2 | 123.4 | 104954 | 341 | 1861 | 1862 | 1863 | 1864 |
| 2 | 127 | 41850 | 264 | 1553 | 1554 | 1555 | 1556 |
| 2 | 134.9 | 31474 | 187 | 1237 | 1238 | 1239 | 1240 |
| 2 | 139.8 | 109207 | 377 | 2005 | 2006 | 2007 | 2008 |
| 2 | 144.2 | 35297 | 212 | 1337 | 1338 | 1339 | 1340 |
| 2 | 152.4 | 43579 | 270 | 1577 | 1578 | 1579 | 1580 |
| 2 | 153.5 | 147548 | 448 | 2289 | 2290 | 2291 | 2292 |
| 2 | 156.6 | 14467 | 84 | 821 | 822 | 823 | 824 |
| 2 | 157.2 | 33320 | 202 | 1297 | 1298 | 1299 | 1300 |
| 2 | 164.2 | 735 | 7 | 509 | 510 | 511 | 512 |
| 2 | 164.2 | 76792 | 308 | 1729 | 1730 | 1731 | 1732 |
| 3 | 6 | 8911 | 45 | 665 | 666 | 667 | 668 |
| 3 | 6 | 51614 | 280 | 1617 | 1618 | 1619 | 1620 |
| 3 | 9.1 | 10667 | 72 | 773 | 774 | 775 | 776 |
| 3 | 19.7 | 19963 | 117 | 953 | 954 | 955 | 956 |
| 3 | 19.7 | 32137 | 196 | 1273 | 1274 | 1275 | 1276 |
| 3 | 46.2 | 49293 | 275 | 1597 | 1598 | 1599 | 1600 |
| 3 | 52.3 | 109315 | 378 | 2009 | 2010 | 2011 | 2012 |
| 3 | 53.5 | 25000 | 144 | 1061 | 1062 | 1063 | 1064 |
| 3 | 54.1 | 21154 | 125 | 985 | 986 | 987 | 988 |
| 3 | 54.1 | 109722 | 384 | 2033 | 2034 | 2035 | 2036 |
| 3 | 57.2 | 109509 | 382 | 2025 | 2026 | 2027 | 2028 |
| 3 | 57.2 | 146158 | 435 | 2237 | 2238 | 2239 | 2240 |
| 3 | 57.5 | 107784 | 365 | 1957 | 1958 | 1959 | 1960 |
| 3 | 58.6 | 29867 | 173 | 1177 | 1178 | 1179 | 1180 |
| 3 | 59.3 | 4599 | 30 | 605 | 606 | 607 | 608 |
| 3 | 59.3 | 21190 | 131 | 1009 | 1010 | 1011 | 1012 |
| 3 | 59.3 | 28923 | 159 | 1121 | 1122 | 1123 | 1124 |
| 3 | 59.3 | 83776 | 328 | 1809 | 1810 | 1811 | 1812 |
| 3 | 59.3 | 147511 | 447 | 2285 | 2286 | 2287 | 2288 |
| 3 | 59.3 | 147768 | 449 | 2293 | 2294 | 2295 | 2296 |
| 3 | 60.4 | 8685 | 39 | 641 | 642 | 643 | 644 |
| 3 | 60.4 | 9468 | 58 | 717 | 718 | 719 | 720 |
| 3 | 60.4 | 9470 | 59 | 721 | 722 | 723 | 724 |
| 3 | 60.5 | 145322 | 432 | 2225 | 2226 | 2227 | 2228 |
| 3 | 61 | 16729 | 103 | 897 | 898 | 899 | 900 |
| 3 | 61.7 | 32247 | 197 | 1277 | 1278 | 1279 | 1280 |
| 3 | 61.7 | 39785 | 251 | 1501 | 1502 | 1503 | 1504 |
| 3 | 62.7 | 9144 | 51 | 689 | 690 | 691 | 692 |
| 3 | 62.7 | 9739 | 69 | 761 | 762 | 763 | 764 |
| 3 | 68.5 | 153431 | 460 | 2337 | 2338 | 2339 | 2340 |
| 3 | 68.5 | 154505 | 474 | 2393 | 2394 | 2395 | 2396 |
| 3 | 68.5 | 154509 | 477 | 2405 | 2406 | 2407 | 2408 |
| 3 | 68.5 | 154511 | 475 | 2397 | 2398 | 2399 | 2400 |
| 3 | 68.5 | 154532 | 472 | 2385 | 2386 | 2387 | 2388 |
| 3 | 68.5 | 154536 | 469 | 2373 | 2374 | 2375 | 2376 |
| 3 | 68.5 | 154552 | 471 | 2381 | 2382 | 2383 | 2384 |
| 3 | 68.5 | 154616 | 473 | 2389 | 2390 | 2391 | 2392 |
| 3 | 68.5 | 155689 | 479 | 2413 | 2414 | 2415 | 2416 |
| 3 | 68.5 | 155708 | 480 | 2417 | 2418 | 2419 | 2420 |
| 3 | 71 | 4886 | 31 | 609 | 610 | 611 | 612 |
| 3 | 71.5 | 24395 | 141 | 1049 | 1050 | 1051 | 1052 |
| 3 | 71.8 | 79081 | 316 | 1761 | 1762 | 1763 | 1764 |
| 3 | 74.3 | 23890 | 145 | 1065 | 1066 | 1067 | 1068 |
| 3 | 79.2 | 9173 | 53 | 697 | 698 | 699 | 700 |
| 3 | 89.7 | 15954 | 93 | 857 | 858 | 859 | 860 |
| 3 | 89.7 | 15965 | 94 | 861 | 862 | 863 | 864 |
| 3 | 93.2 | 77118 | 309 | 1733 | 1734 | 1735 | 1736 |
| 3 | 96.1 | 21772 | 129 | 1001 | 1002 | 1003 | 1004 |
| 3 | 96.5 | 36694 | 229 | 1409 | 1410 | 1411 | 1412 |
| 3 | 98.2 | 111204 | 397 | 2085 | 2086 | 2087 | 2088 |
| 3 | 98.6 | 29390 | 165 | 1145 | 1146 | 1147 | 1148 |
| 3 | 101.3 | 108630 | 375 | 1997 | 1998 | 1999 | 2000 |

TABLE 2-continued

| Chromosome | Position | Marker | SEQ_NUM | Forward | Reverse | FAM | VIC |
|---|---|---|---|---|---|---|---|
| 3 | 105 | 35568 | 217 | 1357 | 1358 | 1359 | 1360 |
| 3 | 106.9 | 9473 | 60 | 725 | 726 | 727 | 728 |
| 3 | 109.4 | 21603 | 127 | 993 | 994 | 995 | 996 |
| 3 | 111.4 | 110780 | 392 | 2065 | 2066 | 2067 | 2068 |
| 3 | 118.4 | 146534 | 439 | 2253 | 2254 | 2255 | 2256 |
| 3 | 118.9 | 56939 | 287 | 1645 | 1646 | 1647 | 1648 |
| 3 | 123.8 | 143969 | 422 | 2185 | 2186 | 2187 | 2188 |
| 3 | 127.7 | 9079 | 50 | 685 | 686 | 687 | 688 |
| 3 | 139.1 | 3970 | 22 | 573 | 574 | 575 | 576 |
| 4 | 1 | 12340 | 77 | 793 | 794 | 795 | 796 |
| 4 | 23.6 | 2739 | 10 | 521 | 522 | 523 | 524 |
| 4 | 38.7 | 110069 | 386 | 2041 | 2042 | 2043 | 2044 |
| 4 | 38.7 | 111464 | 400 | 2097 | 2098 | 2099 | 2100 |
| 4 | 52.8 | 24647 | 146 | 1069 | 1070 | 1071 | 1072 |
| 4 | 53.2 | 40461 | 259 | 1533 | 1534 | 1535 | 1536 |
| 4 | 53.2 | 156243 | 484 | 2433 | 2434 | 2435 | 2436 |
| 4 | 58.6 | 1122 | 6 | 505 | 506 | 507 | 508 |
| 4 | 58.6 | 12012 | 75 | 785 | 786 | 787 | 788 |
| 4 | 62.1 | 10671 | 76 | 789 | 790 | 791 | 792 |
| 4 | 63.2 | 70730 | 305 | 1717 | 1718 | 1719 | 1720 |
| 4 | 64.9 | 38852 | 242 | 1465 | 1466 | 1467 | 1468 |
| 4 | 67.6 | 15096 | 90 | 845 | 846 | 847 | 848 |
| 4 | 67.6 | 154038 | 467 | 2365 | 2366 | 2367 | 2368 |
| 4 | 69.5 | 3351 | 19 | 561 | 562 | 563 | 564 |
| 4 | 69.5 | 5021 | 32 | 613 | 614 | 615 | 616 |
| 4 | 69.5 | 14666 | 88 | 837 | 838 | 839 | 840 |
| 4 | 69.5 | 15247 | 100 | 885 | 886 | 887 | 888 |
| 4 | 69.5 | 37503 | 232 | 1421 | 1422 | 1423 | 1424 |
| 4 | 69.5 | 80475 | 322 | 1785 | 1786 | 1787 | 1788 |
| 4 | 69.5 | 153424 | 464 | 2353 | 2354 | 2355 | 2356 |
| 4 | 69.9 | 107276 | 358 | 1929 | 1930 | 1931 | 1932 |
| 4 | 71.4 | 84527 | 329 | 1813 | 1814 | 1815 | 1816 |
| 4 | 73 | 35294 | 211 | 1333 | 1334 | 1335 | 1336 |
| 4 | 80 | 106845 | 354 | 1913 | 1914 | 1915 | 1916 |
| 4 | 86.5 | 3964 | 21 | 569 | 570 | 571 | 572 |
| 4 | 87.7 | 107840 | 366 | 1961 | 1962 | 1963 | 1964 |
| 4 | 92.1 | 9187 | 54 | 701 | 702 | 703 | 704 |
| 4 | 107.7 | 106491 | 350 | 1897 | 1898 | 1899 | 1900 |
| 4 | 108.2 | 39511 | 249 | 1493 | 1494 | 1495 | 1496 |
| 4 | 109.2 | 23289 | 138 | 1037 | 1038 | 1039 | 1040 |
| 4 | 109.7 | 26846 | 150 | 1085 | 1086 | 1087 | 1088 |
| 4 | 109.7 | 28933 | 161 | 1129 | 1130 | 1131 | 1132 |
| 4 | 110.3 | 8979 | 47 | 673 | 674 | 675 | 676 |
| 4 | 112.4 | 54460 | 285 | 1637 | 1638 | 1639 | 1640 |
| 4 | 115.1 | 71159 | 306 | 1721 | 1722 | 1723 | 1724 |
| 4 | 115.4 | 29435 | 166 | 1149 | 1150 | 1151 | 1152 |
| 4 | 117.6 | 30745 | 179 | 1205 | 1206 | 1207 | 1208 |
| 4 | 119.2 | 2435 | 9 | 517 | 518 | 519 | 520 |
| 4 | 119.2 | 12711 | 78 | 797 | 798 | 799 | 800 |
| 4 | 119.2 | 17828 | 108 | 917 | 918 | 919 | 920 |
| 4 | 119.2 | 18439 | 115 | 945 | 946 | 947 | 948 |
| 4 | 119.2 | 20933 | 121 | 969 | 970 | 971 | 972 |
| 4 | 119.2 | 20934 | 122 | 973 | 974 | 975 | 976 |
| 4 | 119.2 | 24422 | 142 | 1053 | 1054 | 1055 | 1056 |
| 4 | 120.9 | 29194 | 163 | 1137 | 1138 | 1139 | 1140 |
| 4 | 122.4 | 151472 | 456 | 2321 | 2322 | 2323 | 2324 |
| 4 | 128.1 | 32049 | 195 | 1269 | 1270 | 1271 | 1272 |
| 4 | 133.6 | 3224 | 16 | 545 | 546 | 547 | 548 |
| 4 | 133.6 | 3226 | 16 | 549 | 550 | 551 | 552 |
| 4 | 135.1 | 3152 | 13 | 533 | 534 | 535 | 536 |
| 4 | 135.1 | 4445 | 27 | 593 | 594 | 595 | 596 |
| 4 | 135.1 | 13833 | 82 | 813 | 814 | 815 | 816 |
| 4 | 135.8 | 17900 | 109 | 921 | 922 | 923 | 924 |
| 4 | 136.4 | 147219 | 443 | 2269 | 2270 | 2271 | 2272 |
| 4 | 142.1 | 147037 | 441 | 2261 | 2262 | 2263 | 2264 |
| 4 | 143.1 | 43121 | 268 | 1569 | 1570 | 1571 | 1572 |
| 4 | 144.8 | 35338 | 213 | 1341 | 1342 | 1343 | 1344 |
| 5 | 1.6 | 24265 | 140 | 1045 | 1046 | 1047 | 1048 |
| 5 | 1.6 | 31790 | 190 | 1249 | 1250 | 1251 | 1252 |
| 5 | 9.7 | 143251 | 414 | 2153 | 2154 | 2155 | 2156 |
| 5 | 13.8 | 69592 | 303 | 1709 | 1710 | 1711 | 1712 |
| 5 | 16.7 | 57137 | 288 | 1649 | 1650 | 1651 | 1652 |
| 5 | 16.7 | 105613 | 345 | 1877 | 1878 | 1879 | 1880 |
| 5 | 17.2 | 107858 | 367 | 1965 | 1966 | 1967 | 1968 |
| 5 | 27.4 | 91 | 1 | 485 | 486 | 487 | 488 |
| 5 | 31.3 | 5275 | 36 | 629 | 630 | 631 | 632 |
| 5 | 39.9 | 109403 | 381 | 2021 | 2022 | 2023 | 2024 |
| 5 | 41.7 | 16527 | 99 | 881 | 882 | 883 | 884 |

TABLE 2-continued

| Chromosome | Position | Marker | SEQ_NUM | Forward | Reverse | FAM | VIC |
|---|---|---|---|---|---|---|---|
| 5 | 50.9 | 109342 | 380 | 2017 | 2018 | 2019 | 2020 |
| 5 | 51.9 | 16762 | 104 | 901 | 902 | 903 | 904 |
| 5 | 51.9 | 16767 | 105 | 905 | 906 | 907 | 908 |
| 5 | 53.4 | 79519 | 318 | 1769 | 1770 | 1771 | 1772 |
| 5 | 56.5 | 9668 | 66 | 749 | 750 | 751 | 752 |
| 5 | 57.7 | 30270 | 177 | 1197 | 1198 | 1199 | 1200 |
| 5 | 57.7 | 52081 | 281 | 1621 | 1622 | 1623 | 1624 |
| 5 | 57.7 | 77545 | 311 | 1741 | 1742 | 1743 | 1744 |
| 5 | 62.3 | 51419 | 279 | 1613 | 1614 | 1615 | 1616 |
| 5 | 63 | 32272 | 199 | 1285 | 1286 | 1287 | 1288 |
| 5 | 66.9 | 30000 | 174 | 1181 | 1182 | 1183 | 1184 |
| 5 | 66.9 | 146415 | 437 | 2245 | 2246 | 2247 | 2248 |
| 5 | 69.3 | 106912 | 355 | 1917 | 1918 | 1919 | 1920 |
| 5 | 69.6 | 107061 | 356 | 1921 | 1922 | 1923 | 1924 |
| 5 | 69.6 | 144731 | 426 | 2201 | 2202 | 2203 | 2204 |
| 5 | 70.5 | 105854 | 347 | 1885 | 1886 | 1887 | 1888 |
| 5 | 70.8 | 22796 | 136 | 1029 | 1030 | 1031 | 1032 |
| 5 | 70.8 | 27874 | 158 | 1117 | 1118 | 1119 | 1120 |
| 5 | 71.7 | 143216 | 413 | 2149 | 2150 | 2151 | 2152 |
| 5 | 73.2 | 33249 | 201 | 1293 | 1294 | 1295 | 1296 |
| 5 | 76.4 | 29820 | 169 | 1161 | 1162 | 1163 | 1164 |
| 5 | 78.2 | 144687 | 425 | 2197 | 2198 | 2199 | 2200 |
| 5 | 80.2 | 36637 | 227 | 1401 | 1402 | 1403 | 1404 |
| 5 | 80.9 | 143418 | 419 | 2173 | 2174 | 2175 | 2176 |
| 5 | 81.2 | 38478 | 238 | 1449 | 1450 | 1451 | 1452 |
| 5 | 81.5 | 48616 | 274 | 1593 | 1594 | 1595 | 1596 |
| 5 | 83 | 104850 | 337 | 1845 | 1846 | 1847 | 1848 |
| 5 | 83.7 | 148026 | 450 | 2297 | 2298 | 2299 | 2300 |
| 5 | 86.2 | 9297 | 55 | 705 | 706 | 707 | 708 |
| 5 | 87.3 | 106300 | 349 | 1893 | 1894 | 1895 | 1896 |
| 5 | 90.6 | 5480 | 38 | 637 | 638 | 639 | 640 |
| 5 | 100.9 | 35377 | 214 | 1345 | 1346 | 1347 | 1348 |
| 5 | 104.5 | 58375 | 290 | 1657 | 1658 | 1659 | 1660 |
| 5 | 117.1 | 143380 | 416 | 2161 | 2162 | 2163 | 2164 |
| 5 | 136 | 105546 | 343 | 1869 | 1870 | 1871 | 1872 |
| 5 | 150.5 | 31084 | 184 | 1225 | 1226 | 1227 | 1228 |
| 6 | 16.4 | 27615 | 157 | 1113 | 1114 | 1115 | 1116 |
| 6 | 17.3 | 154854 | 476 | 2401 | 2402 | 2403 | 2404 |
| 6 | 19.4 | 105014 | 342 | 1865 | 1866 | 1867 | 1868 |
| 6 | 22.9 | 79529 | 319 | 1773 | 1774 | 1775 | 1776 |
| 6 | 30.5 | 3284 | 18 | 557 | 558 | 559 | 560 |
| 6 | 30.5 | 69630 | 304 | 1713 | 1714 | 1715 | 1716 |
| 6 | 32.8 | 29780 | 168 | 1157 | 1158 | 1159 | 1160 |
| 6 | 32.8 | 68941 | 298 | 1689 | 1690 | 1691 | 1692 |
| 6 | 32.8 | 146458 | 438 | 2249 | 2250 | 2251 | 2252 |
| 6 | 33.3 | 104510 | 334 | 1833 | 1834 | 1835 | 1836 |
| 6 | 33.3 | 107639 | 363 | 1949 | 1950 | 1951 | 1952 |
| 6 | 35.3 | 15304 | 101 | 889 | 890 | 891 | 892 |
| 6 | 35.3 | 16944 | 106 | 909 | 910 | 911 | 912 |
| 6 | 35.3 | 35574 | 218 | 1361 | 1362 | 1363 | 1364 |
| 6 | 35.3 | 77413 | 310 | 1737 | 1738 | 1739 | 1740 |
| 6 | 35.3 | 110607 | 389 | 2053 | 2054 | 2055 | 2056 |
| 6 | 37.3 | 36067 | 221 | 1373 | 1374 | 1375 | 1376 |
| 6 | 37.3 | 36073 | 221 | 1377 | 1378 | 1379 | 1380 |
| 6 | 41.2 | 34560 | 208 | 1321 | 1322 | 1323 | 1324 |
| 6 | 43.1 | 30176 | 176 | 1193 | 1194 | 1195 | 1196 |
| 6 | 52.8 | 4463 | 29 | 601 | 602 | 603 | 604 |
| 6 | 53.1 | 60751 | 294 | 1673 | 1674 | 1675 | 1676 |
| 6 | 53.5 | 32034 | 194 | 1265 | 1266 | 1267 | 1268 |
| 6 | 53.5 | 57758 | 289 | 1653 | 1654 | 1655 | 1656 |
| 6 | 53.5 | 108212 | 372 | 1985 | 1986 | 1987 | 1988 |
| 6 | 58.1 | 59008 | 292 | 1665 | 1666 | 1667 | 1668 |
| 6 | 58.1 | 146195 | 436 | 2241 | 2242 | 2243 | 2244 |
| 6 | 59.9 | 3277 | 17 | 553 | 554 | 555 | 556 |
| 6 | 59.9 | 105586 | 344 | 1873 | 1874 | 1875 | 1876 |
| 6 | 61.5 | 148039 | 453 | 2309 | 2310 | 2311 | 2312 |
| 6 | 61.5 | 155861 | 482 | 2425 | 2426 | 2427 | 2428 |
| 6 | 63.1 | 20410 | 128 | 997 | 998 | 999 | 1000 |
| 6 | 66.6 | 8838 | 43 | 657 | 658 | 659 | 660 |
| 6 | 67.5 | 14694 | 96 | 869 | 870 | 871 | 872 |
| 6 | 73.3 | 113381 | 411 | 2141 | 2142 | 2143 | 2144 |
| 6 | 86.9 | 110972 | 395 | 2077 | 2078 | 2079 | 2080 |
| 6 | 92.8 | 37947 | 237 | 1441 | 1442 | 1443 | 1444 |
| 6 | 92.8 | 37948 | 237 | 1445 | 1446 | 1447 | 1448 |
| 6 | 93.9 | 5319 | 37 | 633 | 634 | 635 | 636 |
| 6 | 95.8 | 30771 | 180 | 1209 | 1210 | 1211 | 1212 |
| 6 | 97.8 | 27295 | 151 | 1089 | 1090 | 1091 | 1092 |
| 6 | 99.1 | 108433 | 373 | 1989 | 1990 | 1991 | 1992 |

TABLE 2-continued

| Chromosome | Position | Marker | SEQ_NUM | Forward | Reverse | FAM | VIC |
|---|---|---|---|---|---|---|---|
| 6 | 110.4 | 31684 | 189 | 1245 | 1246 | 1247 | 1248 |
| 6 | 112.4 | 107449 | 361 | 1941 | 1942 | 1943 | 1944 |
| 6 | 117.4 | 16017 | 107 | 913 | 914 | 915 | 916 |
| 6 | 121 | 37634 | 234 | 1429 | 1430 | 1431 | 1432 |
| 6 | 128.7 | 9667 | 65 | 745 | 746 | 747 | 748 |
| 6 | 130.8 | 21433 | 126 | 989 | 990 | 991 | 992 |
| 6 | 132.7 | 37555 | 233 | 1425 | 1426 | 1427 | 1428 |
| 7 | 56.2 | 68954 | 299 | 1693 | 1694 | 1695 | 1696 |
| 7 | 62 | 31370 | 186 | 1233 | 1234 | 1235 | 1236 |
| 7 | 62 | 42164 | 265 | 1557 | 1558 | 1559 | 1560 |
| 7 | 67 | 30674 | 178 | 1201 | 1202 | 1203 | 1204 |
| 7 | 67.4 | 33769 | 205 | 1309 | 1310 | 1311 | 1312 |
| 7 | 67.9 | 39064 | 244 | 1473 | 1474 | 1475 | 1476 |
| 7 | 69.1 | 35633 | 219 | 1365 | 1366 | 1367 | 1368 |
| 7 | 72.8 | 42930 | 267 | 1565 | 1566 | 1567 | 1568 |
| 7 | 73.8 | 68426 | 296 | 1681 | 1682 | 1683 | 1684 |
| 7 | 73.9 | 29005 | 162 | 1133 | 1134 | 1135 | 1136 |
| 7 | 74 | 51405 | 278 | 1609 | 1610 | 1611 | 1612 |
| 7 | 83.6 | 29362 | 164 | 1141 | 1142 | 1143 | 1144 |
| 7 | 98.5 | 8799 | 42 | 653 | 654 | 655 | 656 |
| 7 | 98.8 | 48425 | 272 | 1585 | 1586 | 1587 | 1588 |
| 7 | 99.8 | 4415 | 26 | 589 | 590 | 591 | 592 |
| 7 | 99.8 | 35408 | 215 | 1349 | 1350 | 1351 | 1352 |
| 7 | 103.6 | 79695 | 320 | 1777 | 1778 | 1779 | 1780 |
| 7 | 107.5 | 38914 | 243 | 1469 | 1470 | 1471 | 1472 |
| 7 | 109.5 | 39978 | 253 | 1509 | 1510 | 1511 | 1512 |
| 7 | 113.3 | 155829 | 481 | 2421 | 2422 | 2423 | 2424 |
| 7 | 114.7 | 28932 | 160 | 1125 | 1126 | 1127 | 1128 |
| 7 | 114.7 | 31547 | 188 | 1241 | 1242 | 1243 | 1244 |
| 7 | 114.7 | 68149 | 295 | 1677 | 1678 | 1679 | 1680 |
| 7 | 115.8 | 4093 | 23 | 577 | 578 | 579 | 580 |
| 7 | 118.6 | 4302 | 24 | 581 | 582 | 583 | 584 |
| 7 | 118.6 | 38653 | 240 | 1457 | 1458 | 1459 | 1460 |
| 7 | 118.6 | 78828 | 314 | 1753 | 1754 | 1755 | 1756 |
| 7 | 118.6 | 81460 | 324 | 1793 | 1794 | 1795 | 1796 |
| 7 | 120.9 | 153856 | 463 | 2349 | 2350 | 2351 | 2352 |
| 7 | 122.2 | 145260 | 429 | 2213 | 2214 | 2215 | 2216 |
| 7 | 124.5 | 15184 | 92 | 853 | 854 | 855 | 856 |
| 7 | 124.5 | 39773 | 250 | 1497 | 1498 | 1499 | 1500 |
| 7 | 131.6 | 79307 | 317 | 1765 | 1766 | 1767 | 1768 |
| 7 | 132.8 | 30026 | 175 | 1185 | 1186 | 1187 | 1188 |
| 7 | 132.8 | 30029 | 175 | 1189 | 1190 | 1191 | 1192 |
| 7 | 144.6 | 30872 | 182 | 1217 | 1218 | 1219 | 1220 |
| 7 | 154.5 | 110771 | 391 | 2061 | 2062 | 2063 | 2064 |
| 7 | 164.7 | 155475 | 478 | 2409 | 2410 | 2411 | 2412 |
| 7 | 165.5 | 146593 | 440 | 2257 | 2258 | 2259 | 2260 |
| 7 | 167 | 143371 | 415 | 2157 | 2158 | 2159 | 2160 |
| 7 | 186.5 | 36490 | 226 | 1397 | 1398 | 1399 | 1400 |
| 7 | 189.3 | 18157 | 112 | 933 | 934 | 935 | 936 |
| 7 | 189.4 | 21038 | 124 | 981 | 982 | 983 | 984 |
| 7 | 189.4 | 69120 | 300 | 1697 | 1698 | 1699 | 1700 |
| 7 | 189.4 | 71624 | 307 | 1725 | 1726 | 1727 | 1728 |
| 7 | 193.9 | 19704 | 123 | 977 | 978 | 979 | 980 |
| 8 | 8.8 | 35173 | 210 | 1329 | 1330 | 1331 | 1332 |
| 8 | 16.4 | 40320 | 256 | 1521 | 1522 | 1523 | 1524 |
| 8 | 16.9 | 19198 | 116 | 949 | 950 | 951 | 952 |
| 8 | 34.3 | 29842 | 172 | 1173 | 1174 | 1175 | 1176 |
| 8 | 40.9 | 107937 | 369 | 1973 | 1974 | 1975 | 1976 |
| 8 | 43.1 | 111628 | 404 | 2113 | 2114 | 2115 | 2116 |
| 8 | 43.3 | 26720 | 154 | 1101 | 1102 | 1103 | 1104 |
| 8 | 45.5 | 32030 | 193 | 1261 | 1262 | 1263 | 1264 |
| 8 | 47.3 | 53899 | 283 | 1629 | 1630 | 1631 | 1632 |
| 8 | 47.9 | 104862 | 339 | 1853 | 1854 | 1855 | 1856 |
| 8 | 49.7 | 107396 | 360 | 1937 | 1938 | 1939 | 1940 |
| 8 | 53.9 | 27361 | 156 | 1109 | 1110 | 1111 | 1112 |
| 8 | 53.9 | 145200 | 428 | 2209 | 2210 | 2211 | 2212 |
| 8 | 55.7 | 23091 | 137 | 1033 | 1034 | 1035 | 1036 |
| 8 | 59.3 | 77568 | 312 | 1745 | 1746 | 1747 | 1748 |
| 8 | 64 | 110148 | 387 | 2045 | 2046 | 2047 | 2048 |
| 8 | 64.5 | 104858 | 338 | 1849 | 1850 | 1851 | 1852 |
| 8 | 65.8 | 104389 | 331 | 1821 | 1822 | 1823 | 1824 |
| 8 | 66.6 | 21895 | 130 | 1005 | 1006 | 1007 | 1008 |
| 8 | 67.4 | 48562 | 273 | 1589 | 1590 | 1591 | 1592 |
| 8 | 68.4 | 82295 | 326 | 1801 | 1802 | 1803 | 1804 |
| 8 | 76.8 | 111472 | 401 | 2101 | 2102 | 2103 | 2104 |
| 8 | 85.9 | 110684 | 390 | 2057 | 2058 | 2059 | 2060 |
| 8 | 87.5 | 9759 | 70 | 765 | 766 | 767 | 768 |
| 8 | 87.5 | 20537 | 120 | 965 | 966 | 967 | 968 |

TABLE 2-continued

| Chromosome | Position | Marker | SEQ_NUM | Forward | Reverse | FAM | VIC |
|---|---|---|---|---|---|---|---|
| 8 | 87.5 | 112497 | 408 | 2129 | 2130 | 2131 | 2132 |
| 8 | 105.5 | 107286 | 359 | 1933 | 1934 | 1935 | 1936 |
| 8 | 106.8 | 13100 | 80 | 805 | 806 | 807 | 808 |
| 8 | 117.3 | 145077 | 427 | 2205 | 2206 | 2207 | 2208 |
| 8 | 117.3 | 145298 | 430 | 2217 | 2218 | 2219 | 2220 |
| 8 | 132.8 | 14545 | 87 | 833 | 834 | 835 | 836 |
| 8 | 135.5 | 8757 | 41 | 649 | 650 | 651 | 652 |
| 8 | 137.4 | 561 | 5 | 501 | 502 | 503 | 504 |
| 9 | 0 | 14479 | 86 | 829 | 830 | 831 | 832 |
| 9 | 20.5 | 58904 | 291 | 1661 | 1662 | 1663 | 1664 |
| 9 | 38.1 | 49557 | 276 | 1601 | 1602 | 1603 | 1604 |
| 9 | 78.2 | 29745 | 167 | 1153 | 1154 | 1155 | 1156 |
| 9 | 87.7 | 12557 | 83 | 817 | 818 | 819 | 820 |
| 9 | 90.3 | 23779 | 139 | 1041 | 1042 | 1043 | 1044 |
| 9 | 93.4 | 29832 | 171 | 1169 | 1170 | 1171 | 1172 |
| 9 | 93.4 | 55370 | 286 | 1641 | 1642 | 1643 | 1644 |
| 9 | 93.8 | 110377 | 388 | 2049 | 2050 | 2051 | 2052 |
| 9 | 93.8 | 113113 | 409 | 2133 | 2134 | 2135 | 2136 |
| 9 | 93.9 | 155159 | 470 | 2377 | 2378 | 2379 | 2380 |
| 9 | 94 | 25961 | 148 | 1077 | 1078 | 1079 | 1080 |
| 9 | 94.5 | 148621 | 454 | 2313 | 2314 | 2315 | 2316 |
| 9 | 94.6 | 112139 | 407 | 2125 | 2126 | 2127 | 2128 |
| 9 | 94.7 | 31233 | 185 | 1229 | 1230 | 1231 | 1232 |
| 9 | 94.7 | 153885 | 465 | 2357 | 2358 | 2359 | 2360 |
| 9 | 100.6 | 20048 | 118 | 957 | 958 | 959 | 960 |
| 9 | 100.6 | 153427 | 461 | 2341 | 2342 | 2343 | 2344 |
| 9 | 108.3 | 109802 | 385 | 2037 | 2038 | 2039 | 2040 |
| 9 | 108.9 | 155793 | 483 | 2429 | 2430 | 2431 | 2432 |
| 9 | 110.3 | 8937 | 46 | 669 | 670 | 671 | 672 |
| 9 | 110.3 | 78438 | 313 | 1749 | 1750 | 1751 | 1752 |
| 9 | 111.2 | 147496 | 446 | 2281 | 2282 | 2283 | 2284 |
| 9 | 112.4 | 13086 | 85 | 825 | 826 | 827 | 828 |
| 9 | 115 | 145318 | 431 | 2221 | 2222 | 2223 | 2224 |
| 9 | 125.2 | 9555 | 62 | 733 | 734 | 735 | 736 |
| 9 | 137.2 | 36022 | 220 | 1369 | 1370 | 1371 | 1372 |
| 9 | 145.8 | 110800 | 393 | 2069 | 2070 | 2071 | 2072 |
| 9 | 165.8 | 110886 | 394 | 2073 | 2074 | 2075 | 2076 |
| 9 | 171.4 | 147417 | 445 | 2277 | 2278 | 2279 | 2280 |
| 10 | 23.9 | 153632 | 462 | 2345 | 2346 | 2347 | 2348 |
| 10 | 23.9 | 153987 | 466 | 2361 | 2362 | 2363 | 2364 |
| 10 | 23.9 | 154021 | 468 | 2369 | 2370 | 2371 | 2372 |
| 10 | 29.7 | 20502 | 119 | 961 | 962 | 963 | 964 |
| 10 | 31.7 | 104672 | 335 | 1837 | 1838 | 1839 | 1840 |
| 10 | 36.9 | 111004 | 396 | 2081 | 2082 | 2083 | 2084 |
| 10 | 43.4 | 16041 | 95 | 865 | 866 | 867 | 868 |
| 10 | 50.5 | 143408 | 418 | 2169 | 2170 | 2171 | 2172 |
| 10 | 51.1 | 147411 | 444 | 2273 | 2274 | 2275 | 2276 |
| 10 | 52.7 | 143754 | 421 | 2181 | 2182 | 2183 | 2184 |
| 10 | 54.7 | 5140 | 34 | 621 | 622 | 623 | 624 |
| 10 | 55.6 | 111212 | 398 | 2089 | 2090 | 2091 | 2092 |
| 10 | 55.8 | 8840 | 44 | 661 | 662 | 663 | 664 |
| 10 | 55.8 | 21292 | 132 | 1013 | 1014 | 1015 | 1016 |
| 10 | 55.8 | 22541 | 133 | 1017 | 1018 | 1019 | 1020 |
| 10 | 55.8 | 143388 | 417 | 2165 | 2166 | 2167 | 2168 |
| 10 | 56.1 | 39275 | 245 | 1477 | 1478 | 1479 | 1480 |
| 10 | 56.7 | 22717 | 134 | 1021 | 1022 | 1023 | 1024 |
| 10 | 57 | 3206 | 15 | 541 | 542 | 543 | 544 |
| 10 | 57 | 32428 | 200 | 1289 | 1290 | 1291 | 1292 |
| 10 | 65.5 | 3640 | 20 | 565 | 566 | 567 | 568 |
| 10 | 66.5 | 16730 | 110 | 925 | 926 | 927 | 928 |
| 10 | 68 | 107941 | 370 | 1977 | 1978 | 1979 | 1980 |
| 10 | 71.6 | 18392 | 114 | 941 | 942 | 943 | 944 |
| 10 | 73.6 | 27447 | 153 | 1097 | 1098 | 1099 | 1100 |
| 10 | 77.4 | 13745 | 91 | 849 | 850 | 851 | 852 |
| 10 | 83.9 | 38604 | 239 | 1453 | 1454 | 1455 | 1456 |
| 10 | 85.9 | 40431 | 258 | 1529 | 1530 | 1531 | 1532 |
| 10 | 85.9 | 40474 | 260 | 1537 | 1538 | 1539 | 1540 |
| 10 | 89.6 | 106742 | 352 | 1905 | 1906 | 1907 | 1908 |
| 10 | 93.2 | 143657 | 420 | 2177 | 2178 | 2179 | 2180 |
| 10 | 93.2 | 145800 | 434 | 2233 | 2234 | 2235 | 2236 |
| 10 | 96.4 | 9486 | 61 | 729 | 730 | 731 | 732 |
| 10 | 100.9 | 109666 | 383 | 2029 | 2030 | 2031 | 2032 |

Example 2

This example illustrates a labeled probe degradation assay for SNP detection and marker mapping.

A quantity of maize genomic template DNA (e.g., about 2-20 ng) is mixed in 5 μL1 total volume with four oligonucleotides, which can be designed by Applied Biosystems, i.e., a forward primer, a reverse primer, a hybridization probe having a VIC reporter attached to the 5' end, and a hybridization probe having a FAM reporter attached to the 5'end as well as PCR reaction buffer containing the passive reference dye ROX. The PCR reaction is conducted for 35 cycles using a 60° C. annealing-extension temperature. Following the reaction, the fluorescence of each fluorophore as well as that of the passive reference is determined in a fluorimeter. The fluorescence value for each fluorophore is normalized to the fluorescence value of the passive reference. The normalized values are plotted against each other for each sample, producing an allelogram as described above. As described above, the data points should fall into clearly separable clusters.

To confirm that an assay produces accurate results, each new assay is performed on a number of replicates of samples of known genotypic identity representing each of the three possible genotypes, i.e., two homozygous alleles and a heterozygous sample. To be a valid and useful assay, it must produce clearly separable clusters of data points, such that one of the three genotypes can be assigned for at least 90% of the data points, and the assignment is observed to be correct for at least 98% of the data points. Subsequent to this validation step, the assay is applied to progeny of a cross between two highly inbred individuals to obtain segregation data, which are then used to calculate a genetic map position for the polymorphic locus.

The maize markers were genetically mapped based on the genotypes of certain SNPs. The genotypes were combined with genotypes for public core SSR and RFLP markers scored on recombinant inbred lines. Before mapping, any loci showing distorted segregation (P<0.01 for a Chi-square test of a 1:1 segregation ratio) were removed. These loci could be added to the map later but without allowing them to change marker order. A map was constructed using the JoinMap version 2.0 software, which is described by Stam ("Construction of integrated genetic linkage maps by means of a new computer package: JoinMap, *The Plant Journal*, 3: 739-744 (1993); Stam, P. and van Ooijen, J. W. "JoinMap version 2.0: Software for the calculation of genetic linkage maps (1995) CPRO-DLO, Wageningen). JoinMap implements a weighted-least squares approach to multipoint mapping in which information from all pairs of linked loci (adjacent or not) is incorporated. Linkage groups were formed using a LOD threshold of 5.0. The SSR and RFLP public markers were used to assign linkage groups to chromosomes. Linkage groups were merged within chromosomes before map construction.

Haldane's mapping function was used to convert recombination fractions to map distances. Lenient criteria was applied for excluding pairwise linkage data; only data with a LOD not greater than 0.001 or a recombination fraction not less than 0.499 are excluded. Parameters for ordering loci were a jump threshold of 5.0, a triplet threshold of 7.0 and a ripple value of 3. About 38% of the loci were ordered in two rounds of map construction with a jump threshold of 5.0, which prevents the addition of a locus to the map if such addition results in a jump of more than 5.0 to a goodness-of-fit criterion. The remaining loci were added to the map without application of such a jump threshold. Addition of these loci had a negligible effect on the map order and distances for the initial loci. Mapped SNP polymorphisms are identified in Table 2.

Example 3

This example illustrates the utility of the markers in marker trait association

The 488 maize markers of this invention were used in an association study to identify which of the candidate genes were more significantly associated with oil level in corn (*Zea mays*).

The University of Illinois has corn lines differing in seed oil that have been developed by long-term selection. A high oil line (IHO) produces about 18% seed oil and a low oil line (ILO) produces about 1.5% seed oil. The IHO and ILO lines are available from the University of Illinois for research. A random mated population (RMn) was produced from random mating offspring of a cross between IHO and ILO by chain crossing for 10 generations to produce an RM10 population. From the RM10 population 504 S1-derived lines were developed by selfing and these lines constitute an association study population. This population along with 72 control samples were genotyped using oil informative SNPs.

Phenotypes were measured on 504 association population lines in replicated field trials with an alph(0,1) incomplete block design. The field trials comprised the 504 lines grown in each of two years at each of 3 locations with 2 replicates per location. The lines were blocked within each replicate. These field trials were performed on the 504 RM10:S1 lines, per se, and on hybrids made by crossing each line to a tester line, i.e., line (7051).

Association was analyzed between the SNP markers and oil level in the RM10:S1 lines, per se, and in the hybrids. A mixed model analysis of variance was performed with sources of variation: location, reps within location, blocks and lines. Line effects estimated from this model were regressed on single marker genotypes (i.e., number of A alleles in the genotypes AA, Aa and aa). The probability that the slope is significantly different from zero gives an indication of whether the marker has a significant effect on the trait. Through this analysis of percent oil in the kernel and oil per 200 kernels in both inbreds and hybrids, a total of 186 markers showed significance at the p<0.05 level. These 186 significant markers are very likely to either reside within an oil gene or to be closely linked to an oil gene and are more particularly described in Table 3 by:

"Map Position" which identifies the distance measured in cM from the 5' end of a maize chromosome for the SNP identified by "Mutation ID", which refers to an arbitrary identifying name for each polymorphism;

Pval % Oil Per se, which refers to probability of a test of significance of the regression of marker genotype on oil level as percent oil per kernel for inbred lines;

Pval % Oil Hybrid, which refers to probability of a test of significance of the regression of marker genotype on oil level as percent oil per kernel for hybrid lines.

Pval Oil/Kernel Per se, which refers to probability of a test of significance of the regression of marker genotype on oil level as oil weight per 200 kernels for inbred lines;

Pval Oil/Kernel Hybrid, which refers to probability of a test of significance of the regression of marker genotype on oil level as oil weight per 200 kernels for hybrid lines

TABLE 3

| Map Position | Mutation_ID | Pval % Oil Per se | Pval % Oil Hybrid | Pval Oil/Kernel Per se | Pval Oil/Kernel Hybrid |
|---|---|---|---|---|---|
| 1-3.7 | 111829 | 0.706 | 0.234 | 0.336 | 0.046 |
| 1-25.1 | 43230 | 0.030 | 0.228 | 0.042 | 0.037 |
| 1-44 | 104827 | 0.094 | 0.801 | 0.018 | 0.909 |
| 1-45 | 151360 | 0.025 | 0.811 | 0.005 | 0.395 |
| 1-46.8 | 37716 | 0.009 | 0.113 | 0.024 | 0.351 |
| 1-53.3 | 42173 | 0.020 | 0.050 | 0.024 | 0.907 |
| 1-58.4 | 116 | 0.059 | 0.018 | 0.018 | 0.395 |
| 1-60.3 | 143100 | 0.722 | 0.029 | 0.878 | 0.501 |
| 1-60.6 | 33819 | 0.200 | 0.039 | 0.043 | 0.640 |
| 1-60.6 | 40189 | 0.007 | 1.6E−4 | 0.062 | 0.172 |
| 1-83.2 | 34205 | 0.026 | 0.151 | 0.090 | 0.022 |
| 1-86.3 | 8984 | 0.405 | 8.0E−4 | 0.433 | 0.069 |
| 1-86.3 | 36286 | 0.261 | 7.3E−4 | 0.328 | 0.069 |
| 1-88.8 | 29829 | 0.063 | 0.164 | 0.597 | 0.029 |
| 1-88.8 | 37068 | 0.026 | 0.317 | 0.068 | 0.051 |
| 1-90.5 | 111828 | 0.052 | 0.198 | 0.018 | 0.014 |
| 1-91 | 113263 | 0.281 | 0.004 | 0.078 | 0.489 |
| 1-91.8 | 104474 | 0.047 | 0.346 | 0.776 | 0.069 |
| 1-96.9 | 36448 | 0.006 | 0.114 | 0.002 | 0.052 |
| 1-99 | 40655 | 0.029 | 0.272 | 0.052 | 0.080 |
| 1-99 | 107077 | 9.7E−6 | 0.014 | 9.1E−4 | 0.021 |
| 1-103.3 | 8719 | 0.167 | 0.728 | 0.008 | 0.271 |
| 1-124.6 | 33373 | 0.029 | 0.240 | 0.201 | 0.714 |
| 1-130.3 | 69565 | 0.032 | 0.201 | 0.568 | 0.962 |
| 1-165.6 | 108862 | 0.011 | 0.001 | 0.402 | 0.347 |
| 1-178.6 | 151382 | 0.027 | 0.480 | 0.116 | 0.509 |
| 1-200.3 | 30840 | 0.662 | 0.050 | 0.716 | 0.012 |
| 2-5.8 | 31064 | 0.091 | 0.002 | 0.143 | 0.064 |
| 2-12.9 | 104447 | 0.077 | 0.012 | 0.697 | 0.459 |
| 2-14.1 | 39289 | 0.095 | 0.016 | 0.778 | 0.571 |
| 2-17.5 | 106678 | 0.048 | 0.003 | 0.043 | 0.040 |
| 2-19.5 | 82235 | 0.018 | 0.002 | 0.045 | 0.009 |
| 2-33.9 | 80031 | 0.101 | 0.046 | 0.557 | 0.036 |
| 2-35.9 | 13691 | 0.225 | 0.469 | 0.040 | 0.419 |
| 2-78.2 | 11466 | 0.096 | 0.761 | 0.045 | 0.225 |
| 2-78.2 | 79073 | 0.020 | 0.825 | 0.015 | 0.413 |
| 2-78.2 | 108493 | 0.142 | 0.045 | 0.713 | 0.299 |
| 2-92.5 | 3177 | 0.082 | 0.334 | 0.038 | 0.224 |
| 2-92.9 | 84829 | 0.298 | 0.324 | 0.111 | 0.031 |
| 2-99.7 | 151288 | 0.549 | 0.036 | 0.245 | 0.846 |
| 2-106 | 111475 | 0.238 | 0.013 | 0.320 | 0.685 |
| 2-106.2 | 108013 | 0.574 | 0.033 | 0.441 | 0.591 |
| 2-107.6 | 2307 | 0.497 | 0.019 | 0.437 | 0.413 |
| 2-114.9 | 22775 | 0.036 | 0.064 | 0.424 | 0.160 |
| 2-123.4 | 104954 | 0.049 | 0.058 | 0.573 | 0.765 |
| 2-152.4 | 43579 | 0.064 | 0.123 | 0.037 | 0.659 |
| 2-164.2 | 735 | 0.497 | 0.920 | 0.048 | 0.729 |
| 2-164.2 | 76792 | 0.939 | 0.524 | 0.044 | 0.345 |
| 3-6 | 8911 | 0.067 | 0.561 | 0.045 | 0.979 |
| 3-6 | 51614 | 0.071 | 0.551 | 0.030 | 0.980 |
| 3-9.1 | 10667 | 0.009 | 0.193 | 0.068 | 0.262 |
| 3-19.7 | 19963 | 0.115 | 0.084 | 0.029 | 0.373 |
| 3-19.7 | 32137 | 2.4E−4 | 1.1E−4 | 2.3E−4 | 0.037 |
| 3-46.2 | 49293 | 0.036 | 0.003 | 0.167 | 0.030 |
| 3-52.3 | 109315 | 0.175 | 0.7E−4 | 0.527 | 0.040 |
| 3-53.5 | 25000 | 0.098 | 4.5E−4 | 0.350 | 0.157 |
| 3-54.1 | 21154 | 0.060 | 7.7E−4 | 0.543 | 0.542 |
| 3-54.1 | 109722 | 0.482 | 0.022 | 0.526 | 0.284 |
| 3-57.2 | 109509 | 0.394 | 0.006 | 0.464 | 0.213 |
| 3-58.6 | 29867 | 0.036 | 1.8E−8 | 0.696 | 0.169 |
| 3-59.3 | 4599 | 0.093 | 7.9E−4 | 0.562 | 0.571 |
| 3-59.3 | 21190 | 0.020 | 0.006 | 0.637 | 0.215 |
| 3-59.3 | 28923 | 0.150 | 9.6E−4 | 0.703 | 0.351 |
| 3-59.3 | 147511 | 0.116 | 0.001 | 0.588 | 0.571 |
| 3-59.3 | 147768 | 0.066 | 7.6E−4 | 0.627 | 0.524 |
| 3-60.4 | 8685 | 0.592 | 0.001 | 0.913 | 0.681 |
| 3-61 | 16729 | 0.229 | 0.112 | 0.198 | 0.005 |
| 3-61.7 | 32247 | 0.115 | 3.5E−4 | 0.891 | 0.113 |
| 3-62.7 | 9144 | 0.066 | 0.003 | 0.277 | 0.014 |
| 3-62.7 | 9739 | 0.031 | 0.003 | 0.439 | 0.130 |
| 3-111.4 | 110780 | 0.246 | 0.040 | 0.572 | 0.207 |
| 3-123.8 | 143969 | 0.015 | 0.158 | 0.081 | 0.438 |
| 3-127.7 | 9079 | 0.040 | 0.071 | 0.296 | 0.134 |
| 4-38.7 | 110069 | 0.026 | 0.048 | 0.188 | 0.108 |
| 4-38.7 | 111464 | 0.029 | 0.053 | 0.129 | 0.096 |
| 4-52.8 | 24647 | 0.013 | 0.084 | 0.382 | 0.827 |

TABLE 3-continued

| Map Position | Mutation_ID | Pval % Oil Per se | Pval % Oil Hybrid | Pval Oil/Kernel Per se | Pval Oil/Kernel Hybrid |
|---|---|---|---|---|---|
| 4-53.2 | 156243 | 0.004 | 0.007 | 0.096 | 0.368 |
| 4-62.1 | 10671 | 0.156 | 0.040 | 0.337 | 0.099 |
| 4-64.9 | 38852 | 0.285 | 0.072 | 0.342 | 0.007 |
| 4-69.5 | 5021 | 0.341 | 0.499 | 0.098 | 0.004 |
| 4-69.5 | 37503 | 0.262 | 0.126 | 0.303 | 0.002 |
| 4-69.9 | 107276 | 0.006 | 0.331 | 0.017 | 0.016 |
| 4-71.4 | 84527 | 0.346 | 0.014 | 0.363 | 0.040 |
| 4-80 | 106845 | 0.112 | 0.042 | 0.393 | 0.434 |
| 4-107.7 | 106491 | 0.020 | 0.040 | 0.409 | 0.521 |
| 4-112.4 | 54460 | 0.037 | 0.146 | 0.124 | 0.150 |
| 4-122.4 | 151472 | 0.186 | 0.994 | 0.011 | 0.967 |
| 4-128.1 | 32049 | 0.195 | 0.620 | 0.756 | 0.011 |
| 4-135.8 | 17900 | 4.2E−4 | 0.037 | 3.7E−4 | 0.019 |
| 4-136.4 | 147219 | 0.038 | 0.214 | 0.104 | 0.029 |
| 5-1.6 | 24265 | 0.082 | 0.035 | 0.472 | 0.010 |
| 5-39.9 | 109403 | 2.0E−6 | 9.1E−5 | 0.135 | 0.006 |
| 5-41.7 | 16527 | 0.028 | 0.161 | 0.333 | 0.791 |
| 5-50.9 | 109342 | 0.005 | 0.167 | 0.015 | 0.024 |
| 5-51.9 | 16762 | 7.6E−5 | 0.018 | 4.9E−4 | 0.029 |
| 5-51.9 | 16767 | 1.2E−4 | 0.017 | 5.1E−4 | 0.033 |
| 5-62.3 | 51419 | 0.046 | 0.002 | 0.163 | 0.031 |
| 5-63 | 32272 | 5.7E−5 | 0.001 | 0.008 | 0.100 |
| 5-66.9 | 30000 | 0.004 | 6.5E−4 | 0.035 | 0.002 |
| 5-66.9 | 146415 | 1.1E−4 | 1.9E−5 | 0.163 | 0.037 |
| 5-69.6 | 144731 | 8.5E−4 | 2.8E−4 | 0.162 | 0.042 |
| 5-70.5 | 105854 | 0.205 | 0.011 | 0.976 | 0.063 |
| 5-71.7 | 143216 | 0.023 | 0.014 | 0.065 | 0.098 |
| 5-76.4 | 29820 | 0.010 | 5.8E−4 | 0.128 | 0.140 |
| 5-80.2 | 36637 | 0.020 | 0.052 | 0.087 | 0.365 |
| 5-104.5 | 58375 | 0.028 | 0.097 | 0.024 | 0.003 |
| 5-150.5 | 31084 | 0.025 | 0.210 | 0.350 | 0.763 |
| 6-17.3 | 154854 | 0.010 | 0.222 | 0.049 | 0.688 |
| 6-30.8 | 69630 | 0.484 | 0.678 | 0.094 | 0.047 |
| 6-37.3 | 36067 | 0.018 | 0.290 | 0.215 | 0.874 |
| 6-37.3 | 36073 | 0.014 | 0.165 | 0.234 | 0.945 |
| 6-43.1 | 30176 | 0.827 | 0.323 | 0.969 | 0.015 |
| 6-52.8 | 4463 | 3.9E−9 | 1.8E−12 | 2.3E−6 | 3.7E−9 |
| 6-53.1 | 60751 | 3.9E−9 | 1.6E−6 | 5.4E−7 | 2.2E−4 |
| 6-53.5 | 32034 | 5.0E−7 | 3.7E−4 | 5.3E−5 | 0.048 |
| 6-53.5 | 57758 | 6.3E−5 | 0.008 | 0.002 | 0.566 |
| 6-53.5 | 108212 | 8.6E−7 | 6.0E−4 | 4.0E−5 | 0.043 |
| 6-58.1 | 59008 | 9.7E−5 | 3.9E−4 | 8.2E−5 | 0.002 |
| 6-58.1 | 146195 | 5.3E−4 | 8.5E−4 | 1.8E−5 | 0.004 |
| 6-59.9 | 3277 | 0.004 | 0.215 | 0.087 | 0.515 |
| 6-59.9 | 105586 | 0.003 | 4.9E−4 | 0.002 | 0.001 |
| 6-61.5 | 148039 | 0.120 | 7.6E−4 | 0.565 | 0.006 |
| 6-61.5 | 155861 | 0.082 | 7.2E−4 | 0.490 | 0.003 |
| 6-63.1 | 20410 | 0.028 | 0.012 | 0.055 | 0.138 |
| 6-66.6 | 8838 | 0.050 | 0.009 | 0.031 | 0.025 |
| 6-67.5 | 14694 | 0.226 | 8.2E−4 | 0.496 | 0.151 |
| 6-86.9 | 110972 | 0.023 | 0.050 | 0.072 | 0.482 |
| 6-110.4 | 31684 | 0.012 | 9.6E−4 | 0.162 | 0.240 |
| 6-121 | 37634 | 0.002 | 0.052 | 0.052 | 0.008 |
| 6-132.7 | 37555 | 0.089 | 0.364 | 0.665 | 0.025 |
| 7-62 | 42164 | 0.075 | 0.424 | 0.045 | 0.235 |
| 7-67 | 30674 | 0.424 | 0.048 | 0.187 | 0.015 |
| 7-68.7 | 39064 | 0.321 | 0.558 | 0.028 | 0.357 |
| 7-72.8 | 42930 | 0.111 | 0.076 | 0.006 | 0.002 |
| 7-74.2 | 68426 | 0.013 | 0.662 | 0.047 | 0.088 |
| 7-98.5 | 8799 | 0.031 | 0.429 | 0.009 | 0.160 |
| 7-98.8 | 48425 | 7.4E−4 | 0.063 | 2.6E−4 | 0.034 |
| 7-99.8 | 4415 | 6.9E−4 | 0.057 | 1.5E−4 | 0.032 |
| 7-99.8 | 35408 | 0.003 | 0.055 | 0.002 | 0.069 |
| 7-107.5 | 38914 | 0.024 | 0.002 | 0.682 | 0.747 |
| 7-115.8 | 4093 | 0.185 | 0.007 | 0.512 | 0.050 |
| 7-118.6 | 4302 | 0.032 | 6.5E−4 | 0.522 | 0.120 |
| 7-118.6 | 38653 | 0.199 | 0.011 | 0.471 | 0.035 |
| 7-118.6 | 81460 | 0.061 | 0.002 | 0.578 | 0.257 |
| 7-122.2 | 145260 | 0.062 | 0.003 | 0.108 | 0.003 |
| 7-124.5 | 15184 | 0.044 | 0.009 | 0.079 | 0.008 |
| 7-124.5 | 39773 | 0.065 | 0.022 | 0.814 | 0.608 |
| 7-132.8 | 30029 | 0.330 | 0.046 | 0.577 | 0.552 |
| 8-16.4 | 40320 | 0.657 | 0.063 | 0.405 | 0.006 |
| 8-40.9 | 107937 | 0.048 | 0.046 | 0.221 | 0.077 |
| 8-43.1 | 111628 | 0.105 | 0.011 | 0.401 | 0.144 |
| 8-45.5 | 26720 | 0.109 | 0.043 | 0.459 | 0.282 |

TABLE 3-continued

| Map Position | Mutation_ID | Pval % Oil Per se | Pval % Oil Hybrid | Pval Oil/Kernel Per se | Pval Oil/Kernel Hybrid |
|---|---|---|---|---|---|
| 8-47.9 | 104862 | 0.152 | 0.143 | 0.011 | 0.276 |
| 8-53.9 | 27361 | 0.798 | 0.947 | 0.378 | 0.048 |
| 8-53.9 | 145200 | 0.260 | 0.129 | 0.033 | 0.016 |
| 8-55.7 | 23091 | 0.040 | 0.183 | 0.069 | 0.872 |
| 8-59.3 | 77568 | 0.003 | 0.258 | 4.4E−5 | 0.249 |
| 8-64 | 110148 | 0.005 | 0.085 | 0.005 | 0.528 |
| 8-65.8 | 104389 | 0.003 | 0.117 | 0.004 | 0.415 |
| 8-66.6 | 21895 | 0.003 | 0.143 | 0.002 | 0.417 |
| 8-67.4 | 48562 | 0.006 | 0.081 | 0.005 | 0.416 |
| 8-68.4 | 82295 | 0.003 | 0.311 | 4.9E−4 | 0.067 |
| 8-85.9 | 110684 | 0.039 | 0.588 | 0.030 | 0.082 |
| 8-87.5 | 9759 | 0.473 | 0.574 | 0.010 | 0.353 |
| 8-105.5 | 107286 | 0.028 | 0.063 | 0.104 | 0.076 |
| 8-106.8 | 13100 | 0.030 | 0.068 | 0.107 | 0.043 |
| 8-117.3 | 145077 | 0.006 | 0.009 | 0.055 | 0.192 |
| 8-117.3 | 145298 | 0.005 | 0.004 | 0.076 | 0.210 |
| 9-20.5 | 58904 | 0.578 | 0.351 | 0.078 | 0.041 |
| 9-80 | 29745 | 0.182 | 0.025 | 0.538 | 0.116 |
| 9-93.8 | 110377 | 0.021 | 0.097 | 0.019 | 0.134 |
| 9-93.8 | 113113 | 0.022 | 0.098 | 0.026 | 0.290 |
| 9-94 | 25961 | 0.058 | 0.047 | 0.039 | 0.177 |
| 9-94.5 | 148621 | 0.060 | 0.300 | 0.030 | 0.066 |
| 9-100.6 | 20048 | 0.034 | 0.137 | 0.155 | 0.156 |
| 9-100.6 | 153427 | 0.022 | 0.154 | 0.092 | 0.101 |
| 9-110.3 | 8937 | 0.014 | 0.652 | 0.035 | 0.233 |
| 9-125.2 | 9555 | 0.419 | 0.270 | 0.307 | 0.049 |
| 9-137.2 | 36022 | 0.136 | 0.014 | 0.290 | 0.096 |
| 10-52.7 | 143754 | 0.608 | 0.127 | 0.648 | 0.044 |
| 10-56.1 | 39275 | 0.061 | 0.019 | 0.054 | 0.085 |
| 10-89.6 | 106742 | 0.064 | 0.105 | 0.035 | 0.088 |
| 10-93.2 | 143657 | 0.560 | 0.046 | 0.790 | 0.186 |
| 10-93.2 | 145800 | 0.551 | 0.030 | 0.793 | 0.190 |
| 10-100.9 | 109666 | 0.083 | 0.007 | 0.144 | 0.148 |
| unmapped | 152577 | 0.315 | 0.001 | 0.627 | 0.914 |
| unmapped | 20742 | 0.425 | 0.141 | 0.435 | 0.041 |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 1 | Amplicon25 | 90 | 106 | 106 | SNP | A | T | | | | | | |
| 1 | Amplicon25 | 91 | 110 | 110 | SNP | C | T | | | | | | |
| 1 | Amplicon25 | 92 | 130 | 130 | SNP | A | T | | | | | | |
| 1 | Amplicon25 | 93 | 175 | 175 | SNP | C | T | | | | | | |
| 1 | Amplicon25 | 94 | 185 | 185 | SNP | A | G | | | | | | |
| 1 | Amplicon25 | 95 | 189 | 189 | SNP | A | G | | | | | | |
| 1 | Amplicon25 | 96 | 279 | 279 | SNP | A | C | | | | | | |
| 1 | Amplicon25 | 97 | 300 | 300 | SNP | C | G | | | | | | |
| 2 | Amplicon29 | 114 | 68 | 68 | SNP | A | C | | | | | | |
| 2 | Amplicon29 | 115 | 101 | 101 | SNP | G | T | | | | | | |
| 2 | Amplicon29 | 116 | 283 | 283 | SNP | A | G | | | | | | |
| 3 | Amplicon78 | 366 | 145 | 145 | SNP | A | G | | | | | | |
| 4 | Amplicon150 | 548 | 84 | 84 | SNP | A | C | | | | | | |
| 4 | Amplicon150 | 549 | 107 | 107 | SNP | C | T | | | | | | |
| 4 | Amplicon150 | 550 | 157 | 157 | SNP | A | T | | | | | | |
| 4 | Amplicon150 | 551 | 174 | 174 | SNP | G | T | | | | | | |
| 5 | Amplicon155 | 561 | 70 | 70 | SNP | A | C | | | | | | |
| 6 | Amplicon161 | 1122 | 215 | 215 | SNP | C | T | | | | | | |
| 6 | Amplicon161 | 1123 | 233 | 233 | SNP | C | T | | | | | | |
| 7 | Amplicon213 | 734 | 11 | 11 | SNP | C | T | | | | | | |
| 7 | Amplicon213 | 735 | 93 | 93 | SNP | A | G | | | | | | |
| 7 | Amplicon213 | 736 | 210 | 210 | SNP | A | G | | | | | | |
| 7 | Amplicon213 | 737 | 216 | 216 | SNP | G | T | | | | | | |
| 7 | Amplicon213 | 738 | 233 | 238 | IND | ****** | ttgagt | | | | | | |
| 8 | Amplicon49714 | 2300 | 59 | 59 | SNP | A | b73 | G | mo17 | | | | |
| 8 | Amplicon49714 | 2301 | 172 | 172 | SNP | G | mo17 | T | b73 | | | | |
| 8 | Amplicon49714 | 2302 | 182 | 182 | SNP | C | mo17 | T | b73 | | | | |
| 8 | Amplicon49714 | 2303 | 221 | 221 | SNP | C | mo17 | T | b73 | | | | |
| 8 | Amplicon49714 | 2304 | 230 | 230 | SNP | C | b73 | T | mo17 | | | | |
| 8 | Amplicon49714 | 2305 | 308 | 308 | SNP | C | mo17 | G | b73 | | | | |
| 8 | Amplicon49714 | 2306 | 344 | 344 | SNP | A | b73 | G | mo17 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 8 | Ampli-con49714 | 2307 | 378 | 378 | SNP | A | b73 | G | mo17 | | | | |
| 8 | Ampli-con49714 | 2308 | 389 | 389 | SNP | C | b73 | G | mo17 | | | | |
| 8 | Ampli-con49714 | 2309 | 424 | 424 | SNP | C | b73 | T | mo17 | | | | |
| 8 | Ampli-con49714 | 2310 | 446 | 446 | SNP | C | mo17 | T | b73 | | | | |
| 9 | Ampli-con49778 | 2435 | 355 | 355 | SNP | C | mo17 | T | b73 | | | | |
| 10 | Ampli-con49935 | 2739 | 133 | 133 | IND | * | b73 | C | mo17 | | | | |
| 11 | Ampli-con49980 | 2841 | 158 | 158 | SNP | C | b73 | T | mo17 | | | | |
| 11 | Ampli-con49980 | 2842 | 215 | 215 | SNP | C | mo17 | T | b73 | | | | |
| 11 | Ampli-con49980 | 2843 | 303 | 303 | SNP | A | mo17 | C | b73 | | | | |
| 11 | Ampli-con49980 | 2844 | 304 | 304 | SNP | C | mo17 | T | b73 | | | | |
| 11 | Ampli-con49980 | 2845 | 380 | 380 | SNP | G | mo17 | T | b73 | | | | |
| 11 | Ampli-con49980 | 2846 | 434 | 434 | SNP | C | mo17 | T | b73 | | | | |
| 11 | Ampli-con49980 | 2847 | 445 | 445 | SNP | G | mo17 | T | b73 | | | | |
| 11 | Ampli-con49980 | 2848 | 466 | 466 | SNP | A | mo17 | G | b73 | | | | |
| 12 | Ampli-con50024 | 2941 | 99 | 99 | SNP | C | b73 | T | mo17 | | | | |
| 12 | Ampli-con50024 | 2942 | 127 | 127 | SNP | A | b73 | T | mo17 | | | | |
| 12 | Ampli-con50024 | 2943 | 169 | 169 | SNP | A | b73 | G | mo17 | | | | |
| 12 | Ampli-con50024 | 2944 | 234 | 240 | IND | ******** | mo17 | GGCTACA | b73 | | | | |
| 12 | Ampli-con50024 | 2945 | 255 | 255 | SNP | A | mo17 | G | b73 | | | | |
| 12 | Ampli-con50024 | 2946 | 270 | 270 | SNP | A | mo17 | T | b73 | | | | |
| 12 | Ampli-con50024 | 2947 | 304 | 304 | SNP | C | b73 | T | mo17 | | | | |
| 12 | Ampli-con50024 | 2948 | 351 | 351 | SNP | A | mo17 | G | b73 | | | | |
| 12 | Ampli-con50024 | 2949 | 361 | 361 | SNP | G | b73 | T | mo17 | | | | |
| 12 | Ampli-con50024 | 2950 | 363 | 363 | SNP | G | b73 | T | mo17 | | | | |
| 12 | Ampli-con50024 | 2951 | 378 | 378 | SNP | C | b73 | T | mo17 | | | | |
| 12 | Ampli-con50024 | 2952 | 398 | 398 | SNP | A | b73 | C | mo17 | | | | |
| 12 | Ampli-con50024 | 2953 | 401 | 401 | SNP | C | mo17 | T | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 12 | Ampli-con50024 | 2954 | 406 | 406 | SNP | C | mo17 | G | b73 | | | | |
| 12 | Ampli-con50024 | 2955 | 417 | 417 | SNP | C | mo17 | G | b73 | | | | |
| 12 | Ampli-con50024 | 2956 | 442 | 442 | SNP | A | mo17 | G | b73 | | | | |
| 12 | Ampli-con50024 | 2957 | 477 | 477 | SNP | G | b73 | T | mo17 | | | | |
| 12 | Ampli-con50024 | 2958 | 503 | 503 | SNP | C | b73 | T | mo17 | | | | |
| 12 | Ampli-con50024 | 2959 | 514 | 514 | IND | * | mo17 | T | b73 | | | | |
| 12 | Ampli-con50024 | 2960 | 556 | 556 | SNP | C | b73 | G | mo17 | | | | |
| 12 | Ampli-con50024 | 2961 | 557 | 557 | IND | * | b73 | G | mo17 | | | | |
| 12 | Ampli-con50024 | 2962 | 559 | 559 | IND | * | b73 | C | mo17 | | | | |
| 13 | Ampli-con50099 | 3152 | 290 | 290 | SNP | C | b73 | G | mo17 | | | | |
| 14 | Ampli-con50106 | 3172 | 94 | 94 | SNP | A | b73 | C | mo17 | | | | |
| 14 | Ampli-con50106 | 3173 | 187 | 187 | SNP | A | b73 | G | mo17 | | | | |
| 14 | Ampli-con50106 | 3174 | 243 | 243 | IND | * | b73 | A | mo17 | | | | |
| 14 | Ampli-con50106 | 3175 | 243 | 244 | IND | ** | b73 | AT | mo17 | | | | |
| 14 | Ampli-con50106 | 3176 | 283 | 283 | SNP | A | b73 | G | mo17 | | | | |
| 14 | Ampli-con50106 | 3177 | 415 | 416 | IND | ** | mo17 | TC | b73 | | | | |
| 14 | Ampli-con50106 | 3178 | 438 | 438 | SNP | C | mo17 | T | b73 | | | | |
| 14 | Ampli-con50106 | 3179 | 442 | 442 | SNP | C | b73 | T | mo17 | | | | |
| 15 | Ampli-con50125 | 3180 | 443 | 443 | SNP | A | b73 | G | mo17 | | | | |
| 15 | Ampli-con50125 | 3205 | 215 | 215 | SNP | C | mo17 | G | b73 | | | | |
| 16 | Ampli-con50142 | 3206 | 256 | 256 | SNP | C | mo17 | T | b73 | | | | |
| 16 | Ampli-con50142 | 3222 | 104 | 104 | SNP | C | b73 | T | mo17 | | | | |
| 16 | Ampli-con50142 | 3223 | 110 | 110 | SNP | C | b73 | T | mo17 | | | | |
| 16 | Ampli-con50142 | 3224 | 171 | 171 | SNP | C | mo17 | G | b73 | | | | |
| 16 | Ampli-con50142 | 3225 | 372 | 374 | IND | *** | b73 | CGG | mo17 | | | | |
| 16 | Ampli-con50142 | 3226 | 401 | 401 | SNP | C | mo17 | T | b73 | | | | |
| 17 | Ampli-con50179 | 3277 | 83 | 83 | SNP | C | mo17 | T | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 17 | Amplicon50179 | 3278 | 265 | 271 | IND | ******** | mo17 | AAGTACC | b73 | | | | |
| 17 | Amplicon50179 | 3279 | 265 | 272 | IND | ********* | mo17 | AAGTACCT | b73 | | | | |
| 17 | Amplicon50179 | 3280 | 338 | 338 | SNP | C | mo17 | T | b73 | | | | |
| 18 | Amplicon50182 | 3282 | 52 | 52 | SNP | G | b73 | T | mo17 | | | | |
| 18 | Amplicon50182 | 3283 | 93 | 93 | SNP | C | mo17 | G | b73 | | | | |
| 18 | Amplicon50182 | 3284 | 438 | 438 | SNP | C | b73 | G | mo17 | | | | |
| 18 | Amplicon50182 | 3285 | 480 | 480 | IND | * | mo17 | G | b73 | | | | |
| 18 | Amplicon50182 | 3286 | 537 | 539 | IND | *** | b73 | CGA | mo17 | | | | |
| 18 | Amplicon50182 | 3287 | 537 | 540 | IND | **** | b73 | CGAT | mo17 | | | | |
| 19 | Amplicon50190 | 3341 | 54 | 54 | SNP | A | mo17 | G | b73 | | | | |
| 19 | Amplicon50190 | 3342 | 91 | 91 | SNP | A | mo17 | G | b73 | | | | |
| 19 | Amplicon50190 | 3343 | 100 | 100 | SNP | A | b73 | G | mo17 | | | | |
| 19 | Amplicon50190 | 3344 | 104 | 104 | SNP | A | mo17 | C | b73 | | | | |
| 19 | Amplicon50190 | 3345 | 146 | 146 | SNP | C | b73 | T | mo17 | | | | |
| 19 | Amplicon50190 | 3346 | 197 | 197 | SNP | C | b73 | G | mo17 | | | | |
| 19 | Amplicon50190 | 3347 | 208 | 208 | SNP | A | mo17 | G | b73 | | | | |
| 19 | Amplicon50190 | 3348 | 266 | 266 | SNP | A | mo17 | C | b73 | | | | |
| 19 | Amplicon50190 | 3349 | 290 | 290 | SNP | A | b73 | G | mo17 | | | | |
| 19 | Amplicon50190 | 3350 | 314 | 314 | SNP | C | b73 | T | mo17 | | | | |
| 19 | Amplicon50190 | 3351 | 431 | 431 | SNP | A | mo17 | C | b73 | | | | |
| 19 | Amplicon50190 | 3352 | 438 | 438 | SNP | A | mo17 | C | b73 | | | | |
| 19 | Amplicon50190 | 3353 | 468 | 468 | SNP | C | b73 | T | mo17 | | | | |
| 19 | Amplicon50190 | 3354 | 552 | 553 | IND | ** | b73 | AA | mo17 | | | | |
| 20 | Amplicon50302 | 3640 | 444 | 444 | SNP | C | b73 | G | mo17 | | | | |
| 21 | Amplicon50453 | 3964 | 170 | 170 | SNP | G | mo17 | T | b73 | | | | |
| 21 | Amplicon50453 | 3965 | 209 | 209 | SNP | G | b73 | T | mo17 | | | | |
| 21 | Amplicon50453 | 3966 | 286 | 286 | SNP | C | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 21 | Ampli-con50453 | 3967 | 359 | 359 | SNP | G | mo17 | T | b73 | | | | |
| 22 | Ampli-con50455 | 3970 | 354 | 354 | SNP | A | mo17 | G | b73 | | | | |
| 23 | Ampli-con50517 | 4091 | 47 | 47 | IND | * | b73 | G | mo17 | | | | |
| 23 | Ampli-con50517 | 4092 | 51 | 51 | SNP | C | b73 | T | mo17 | | | | |
| 23 | Ampli-con50517 | 4093 | 67 | 67 | SNP | A | b73 | T | mo17 | | | | |
| 23 | Ampli-con50517 | 4094 | 74 | 74 | IND | * | mo17 | T | b73 | | | | |
| 23 | Ampli-con50517 | 4095 | 88 | 88 | SNP | A | mo17 | C | b73 | | | | |
| 23 | Ampli-con50517 | 4096 | 91 | 91 | SNP | A | mo17 | C | b73 | | | | |
| 23 | Ampli-con50517 | 4097 | 92 | 92 | IND | * | b73 | G | mo17 | | | | |
| 23 | Ampli-con50517 | 4098 | 146 | 146 | SNP | A | b73 | G | mo17 | | | | |
| 23 | Ampli-con50517 | 4099 | 181 | 185 | IND | ***** | b73 | CCAGG | mo17 | | | | |
| 23 | Ampli-con50517 | 4100 | 231 | 231 | SNP | A | mo17 | G | b73 | | | | |
| 23 | Ampli-con50517 | 4101 | 290 | 293 | IND | **** | mo17 | GATC | b73 | | | | |
| 23 | Ampli-con50517 | 4102 | 360 | 360 | SNP | G | mo17 | T | b73 | | | | |
| 23 | Ampli-con50517 | 4103 | 361 | 361 | SNP | A | mo17 | C | b73 | | | | |
| 23 | Ampli-con50517 | 4104 | 364 | 364 | SNP | G | b73 | T | mo17 | | | | |
| 23 | Ampli-con50517 | 4105 | 365 | 365 | SNP | C | b73 | G | mo17 | | | | |
| 23 | Ampli-con50517 | 4106 | 415 | 415 | SNP | G | mo17 | T | b73 | | | | |
| 23 | Ampli-con50517 | 4107 | 432 | 432 | SNP | A | b73 | C | mo17 | | | | |
| 24 | Ampli-con50606 | 4300 | 77 | 77 | SNP | G | b73 | T | mo17 | | | | |
| 24 | Ampli-con50606 | 4301 | 232 | 232 | SNP | C | mo17 | T | b73 | | | | |
| 24 | Ampli-con50606 | 4302 | 357 | 357 | SNP | C | b73 | T | mo17 | | | | |
| 25 | Ampli-con50664 | 4408 | 61 | 61 | SNP | A | b73 | G | mo17 | | | | |
| 25 | Ampli-con50664 | 4409 | 124 | 124 | IND | * | mo17 | A | b73 | | | | |
| 25 | Ampli-con50664 | 4410 | 203 | 203 | SNP | C | mo17 | T | b73 | | | | |
| 25 | Ampli-con50664 | 4411 | 207 | 207 | SNP | A | mo17 | G | b73 | | | | |
| 26 | Ampli-con50676 | 4415 | 291 | 291 | SNP | A | mo17 | C | b73 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 27 | Ampli-con50691 | 4444 | 26 | 26 | SNP | A | b73 | T | mo17 | | | | |
| 27 | Ampli-con50691 | 4445 | 273 | 273 | SNP | C | mo17 | T | b73 | | | | |
| 28 | Ampli-con50693 | 4446 | 33 | 33 | SNP | C | b73 | T | mo17 | | | | |
| 28 | Ampli-con50693 | 4447 | 41 | 41 | SNP | A | mo17 | G | b73 | | | | |
| 28 | Ampli-con50693 | 4448 | 68 | 68 | SNP | C | mo17 | G | b73 | | | | |
| 28 | Ampli-con50693 | 4449 | 111 | 111 | SNP | C | mo17 | G | b73 | | | | |
| 28 | Ampli-con50693 | 4450 | 124 | 124 | SNP | A | b73 | G | mo17 | | | | |
| 28 | Ampli-con50693 | 4451 | 328 | 328 | SNP | A | b73 | G | mo17 | | | | |
| 28 | Ampli-con50693 | 4452 | 340 | 340 | SNP | A | mo17 | T | b73 | | | | |
| 28 | Ampli-con50693 | 4453 | 377 | 377 | SNP | C | b73 | T | mo17 | | | | |
| 28 | Ampli-con50693 | 4454 | 412 | 412 | SNP | A | b73 | G | mo17 | | | | |
| 29 | Ampli-con50693 | 4463 | 281 | 281 | SNP | C | b73 | T | mo17 | | | | |
| 30 | Ampli-con50699 | 4598 | 100 | 100 | SNP | A | mo17 | C | b73 | | | | |
| 30 | Ampli-con50748 | 4599 | 104 | 104 | SNP | C | mo17 | T | b73 | | | | |
| 31 | Ampli-con50748 | 4886 | 548 | 548 | SNP | C | b73 | T | mo17 | | | | |
| 32 | Ampli-con50852 | 5021 | 371 | 371 | SNP | C | mo17 | T | b73 | | | | |
| 33 | Ampli-con50932 | 5097 | 109 | 109 | IND | * | mo17 | T | b73 | | | | |
| 33 | Ampli-con50995 | 5098 | 138 | 138 | SNP | A | b73 | G | mo17 | | | | |
| 33 | Ampli-con50995 | 5099 | 230 | 230 | SNP | G | mo17 | T | b73 | | | | |
| 33 | Ampli-con50995 | 5100 | 321 | 321 | SNP | A | mo17 | C | b73 | | | | |
| 33 | Ampli-con50995 | 5101 | 331 | 331 | IND | * | b73 | G | mo17 | | | | |
| 33 | Ampli-con50995 | 5102 | 351 | 351 | SNP | A | b73 | C | mo17 | | | | |
| 33 | Ampli-con50995 | 5103 | 366 | 366 | SNP | A | mo17 | G | b73 | | | | |
| 33 | Ampli-con50995 | 5104 | 417 | 417 | SNP | A | b73 | G | mo17 | | | | |
| 33 | Ampli-con50995 | 5105 | 436 | 436 | SNP | A | b73 | T | mo17 | | | | |
| 33 | Ampli-con50995 | 5106 | 519 | 519 | SNP | C | b73 | T | mo17 | | | | |
| 33 | Ampli-con50995 | 5107 | 576 | 576 | SNP | A | b73 | G | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 34 | Ampli-con51024 | 5139 | 189 | 189 | SNP | C | mo17 | T | b73 | | | | |
| 34 | Ampli-con51024 | 5140 | 347 | 347 | SNP | C | mo17 | T | b73 | | | | |
| 35 | Ampli-con51063 | 5215 | 494 | 494 | SNP | A | mo17 | T | b73 | | | | |
| 36 | Ampli-con51114 | 5274 | 185 | 185 | IND | * | mo17 | G | b73 | | | | |
| 36 | Ampli-con51114 | 5275 | 222 | 222 | SNP | A | mo17 | G | b73 | | | | |
| 36 | Ampli-con51114 | 5276 | 358 | 358 | SNP | A | mo17 | T | b73 | | | | |
| 36 | Ampli-con51114 | 5277 | 451 | 451 | SNP | C | b73 | T | mo17 | | | | |
| 37 | Ampli-con51134 | 5314 | 279 | 279 | SNP | C | mo17 | G | b73 | | | | |
| 37 | Ampli-con51134 | 5315 | 340 | 340 | SNP | A | mo17 | G | b73 | | | | |
| 37 | Ampli-con51134 | 5316 | 442 | 442 | SNP | A | b73 | G | mo17 | | | | |
| 37 | Ampli-con51134 | 5317 | 443 | 443 | SNP | A | b73 | C | mo17 | | | | |
| 37 | Ampli-con51134 | 5318 | 467 | 467 | SNP | A | b73 | T | mo17 | | | | |
| 37 | Ampli-con51134 | 5319 | 479 | 479 | SNP | A | b73 | G | mo17 | | | | |
| 38 | Ampli-con51241 | 5480 | 173 | 173 | SNP | A | b73 | G | mo17 | | | | |
| 38 | Ampli-con51241 | 5481 | 325 | 325 | SNP | A | mo17 | G | b73 | | | | |
| 38 | Ampli-con51241 | 5482 | 405 | 405 | SNP | C | b73 | T | mo17 | | | | |
| 39 | Ampli-con51241 | 8685 | 112 | 112 | SNP | A | mo17 | G | b73 | | | | |
| 40 | Ampli-con173892 | 8716 | 118 | 118 | IND | * | b73 | A | mo17 | | | | |
| 40 | Ampli-con173943 | 8717 | 129 | 129 | SNP | C | mo17 | G | b73 | | | | |
| 40 | Ampli-con173943 | 8718 | 197 | 197 | SNP | A | mo17 | G | b73 | | | | |
| 40 | Ampli-con173943 | 8719 | 257 | 257 | SNP | A | b73 | G | mo17 | | | | |
| 40 | Ampli-con173943 | 8720 | 286 | 286 | SNP | A | b73 | C | mo17 | | | | |
| 41 | Ampli-con173943 | 8757 | 285 | 285 | SNP | C | mo17 | T | b73 | | | | |
| 41 | Ampli-con173990 | 8758 | 323 | 323 | SNP | A | b73 | C | mo17 | | | | |
| 41 | Ampli-con173990 | 8759 | 379 | 379 | SNP | A | b73 | G | mo17 | | | | |
| 41 | Ampli-con173990 | 8760 | 412 | 412 | SNP | A | b73 | T | mo17 | | | | |
| 41 | Ampli-con173990 | 8761 | 413 | 413 | IND | * | mo17 | C | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 41 | Ampli-con173990 | 8762 | 427 | 427 | SNP | A | mo17 | T | b73 | | | | |
| 42 | Ampli-con174021 | 8799 | 352 | 352 | SNP | A | mo17 | G | b73 | | | | |
| 42 | Ampli-con174021 | 8800 | 445 | 445 | SNP | A | mo17 | G | b73 | | | | |
| 43 | Ampli-con174108 | 8838 | 294 | 294 | SNP | A | b73 | G | mo17 | | | | |
| 44 | Ampli-con174113 | 8840 | 108 | 108 | SNP | A | b73 | G | mo17 | | | | |
| 45 | Ampli-con174252 | 8911 | 211 | 211 | SNP | A | b73 | G | mo17 | | | | |
| 46 | Ampli-con174322 | 8937 | 151 | 151 | SNP | A | mo17 | T | b73 | | | | |
| 47 | Ampli-con174423 | 8979 | 196 | 196 | SNP | A | mo17 | T | b73 | | | | |
| 48 | Ampli-con174434 | 8981 | 58 | 58 | SNP | A | b73 | G | mo17 | | | | |
| 48 | Ampli-con174434 | 8982 | 358 | 358 | SNP | A | b73 | G | mo17 | | | | |
| 49 | Ampli-con174442 | 8984 | 402 | 402 | SNP | C | mo17 | T | b73 | | | | |
| 50 | Ampli-con174632 | 9079 | 126 | 126 | SNP | C | b73 | T | mo17 | | | | |
| 51 | Ampli-con174763 | 9142 | 86 | 86 | IND | * | mo17 | C | b73 | | | | |
| 51 | Ampli-con174763 | 9143 | 96 | 96 | IND | * | mo17 | C | b73 | | | | |
| 52 | Ampli-con174793 | 9144 | 233 | 233 | SNP | A | mo17 | T | b73 | | | | |
| 52 | Ampli-con174793 | 9157 | 167 | 167 | SNP | C | b73 | G | mo17 | | | | |
| 52 | Ampli-con174793 | 9158 | 318 | 318 | SNP | A | b73 | G | mo17 | | | | |
| 52 | Ampli-con174793 | 9159 | 359 | 359 | SNP | C | mo17 | T | b73 | | | | |
| 52 | Ampli-con174793 | 9160 | 396 | 396 | SNP | C | b73 | G | mo17 | | | | |
| 52 | Ampli-con174793 | 9161 | 399 | 399 | SNP | A | b73 | C | mo17 | | | | |
| 52 | Ampli-con174793 | 9162 | 412 | 412 | SNP | A | b73 | C | mo17 | | | | |
| 53 | Ampli-con174811 | 9173 | 133 | 133 | SNP | A | mo17 | C | b73 | | | | |
| 53 | Ampli-con174811 | 9174 | 163 | 166 | IND | **** | mo17 | GTAT | b73 | | | | |
| 53 | Ampli-con174811 | 9175 | 173 | 173 | SNP | A | b73 | G | mo17 | | | | |
| 53 | Ampli-con174811 | 9176 | 174 | 174 | SNP | C | mo17 | T | b73 | | | | |
| 54 | Ampli-con174832 | 9187 | 146 | 146 | SNP | C | b73 | T | mo17 | | | | |
| 54 | Ampli-con174832 | 9188 | 244 | 245 | IND | ** | b73 | TT | mo17 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 54 | Ampli-con174832 | 9189 | 248 | 249 | IND | ** | b73 | CC | mo17 | | | | |
| 54 | Ampli-con174832 | 9190 | 268 | 268 | SNP | C | mo17 | T | b73 | | | | |
| 54 | Ampli-con174832 | 9191 | 275 | 275 | IND | * | b73 | T | mo17 | | | | |
| 54 | Ampli-con174832 | 9192 | 285 | 285 | SNP | A | mo17 | G | b73 | | | | |
| 54 | Ampli-con174832 | 9193 | 367 | 367 | SNP | C | mo17 | G | b73 | | | | |
| 55 | Ampli-con175020 | 9297 | 118 | 118 | SNP | A | mo17 | G | b73 | | | | |
| 55 | Ampli-con175020 | 9298 | 189 | 189 | SNP | A | b73 | T | mo17 | | | | |
| 55 | Ampli-con175020 | 9299 | 195 | 195 | SNP | A | mo17 | G | b73 | | | | |
| 56 | Ampli-con175137 | 9364 | 409 | 409 | SNP | C | mo17 | T | b73 | | | | |
| 57 | Ampli-con175303 | 9449 | 209 | 209 | SNP | A | mo17 | G | b73 | | | | |
| 57 | Ampli-con175303 | 9450 | 262 | 266 | IND | ***** | mo17 | CCTTG | b73 | | | | |
| 57 | Ampli-con175303 | 9451 | 426 | 426 | SNP | A | mo17 | T | b73 | | | | |
| 58 | Ampli-con175327 | 9467 | 57 | 57 | IND | * | mo17 | T | b73 | | | | |
| 58 | Ampli-con175327 | 9468 | 126 | 126 | SNP | A | b73 | G | mo17 | | | | |
| 58 | Ampli-con175327 | 9469 | 333 | 333 | SNP | A | mo17 | G | b73 | | | | |
| 59 | Ampli-con175328 | 9470 | 154 | 154 | SNP | C | mo17 | G | b73 | | | | |
| 59 | Ampli-con175328 | 9471 | 213 | 215 | IND | *** | b73 | TAG | mo17 | | | | |
| 60 | Ampli-con175332 | 9472 | 146 | 146 | IND | * | b73 | A | mo17 | | | | |
| 60 | Ampli-con175332 | 9473 | 335 | 335 | SNP | C | mo17 | T | mo17 | | | | |
| 61 | Ampli-con175347 | 9485 | 153 | 153 | SNP | A | b73 | C | mo17 | | | | |
| 61 | Ampli-con175347 | 9486 | 242 | 242 | SNP | A | b73 | T | mo17 | | | | |
| 62 | Ampli-con175497 | 9553 | 73 | 73 | SNP | A | b73 | T | mo17 | | | | |
| 62 | Ampli-con175497 | 9554 | 263 | 263 | SNP | A | mo17 | G | b73 | | | | |
| 62 | Ampli-con175497 | 9555 | 284 | 284 | SNP | A | mo17 | C | b73 | | | | |
| 62 | Ampli-con175497 | 9556 | 289 | 289 | SNP | A | mo17 | C | b73 | | | | |
| 62 | Ampli-con175497 | 9557 | 374 | 374 | SNP | A | mo17 | C | b73 | | | | |
| 63 | Ampli-con175582 | 9622 | 37 | 37 | SNP | C | mo17 | T | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 63 | Ampli-con175582 | 9623 | 198 | 198 | SNP | C | b73 | T | mo17 | | | | |
| 63 | Ampli-con175582 | 9624 | 258 | 258 | SNP | A | b73 | G | mo17 | | | | |
| 63 | Ampli-con175582 | 9625 | 354 | 354 | SNP | C | mo17 | T | b73 | | | | |
| 64 | Ampli-con175589 | 9626 | 238 | 238 | SNP | C | mo17 | G | b73 | | | | |
| 64 | Ampli-con175589 | 9627 | 260 | 260 | SNP | A | b73 | C | mo17 | | | | |
| 65 | Ampli-con175642 | 9667 | 240 | 240 | SNP | C | b73 | G | mo17 | | | | |
| 66 | Ampli-con175645 | 9668 | 108 | 108 | SNP | A | b73 | G | mo17 | | | | |
| 66 | Ampli-con175645 | 9669 | 388 | 388 | SNP | A | mo17 | T | b73 | | | | |
| 67 | Ampli-con175693 | 9698 | 330 | 330 | SNP | C | b73 | G | mo17 | | | | |
| 67 | Ampli-con175693 | 9699 | 347 | 350 | IND | **** | b73 | GTTG | mo17 | | | | |
| 67 | Ampli-con175693 | 9700 | 352 | 354 | IND | *** | b73 | TTT | mo17 | | | | |
| 67 | Ampli-con175693 | 9701 | 448 | 448 | SNP | A | b73 | G | mo17 | | | | |
| 68 | Ampli-con175701 | 9703 | 21 | 21 | SNP | G | b73 | T | mo17 | | | | |
| 68 | Ampli-con175701 | 9704 | 61 | 61 | SNP | C | mo17 | T | b73 | | | | |
| 68 | Ampli-con175701 | 9705 | 213 | 213 | SNP | C | mo17 | T | b73 | | | | |
| 68 | Ampli-con175701 | 9706 | 284 | 284 | SNP | A | b73 | G | mo17 | | | | |
| 68 | Ampli-con175701 | 9707 | 381 | 381 | SNP | A | mo17 | G | b73 | | | | |
| 68 | Ampli-con175701 | 9708 | 402 | 402 | SNP | G | b73 | T | mo17 | | | | |
| 68 | Ampli-con175701 | 9709 | 418 | 418 | SNP | C | b73 | T | mo17 | | | | |
| 68 | Ampli-con175701 | 9710 | 419 | 419 | SNP | A | mo17 | C | b73 | | | | |
| 68 | Ampli-con175701 | 9711 | 435 | 435 | SNP | A | mo17 | G | b73 | | | | |
| 69 | Ampli-con175758 | 9739 | 290 | 290 | SNP | A | b73 | G | mo17 | | | | |
| 70 | Ampli-con175783 | 9759 | 167 | 167 | SNP | A | mo17 | G | b73 | | | | |
| 70 | Ampli-con175783 | 9760 | 220 | 220 | SNP | A | b73 | G | mo17 | | | | |
| 70 | Ampli-con175783 | 9761 | 275 | 275 | SNP | A | mo17 | G | b73 | | | | |
| 70 | Ampli-con175783 | 9762 | 282 | 282 | SNP | A | b73 | T | mo17 | | | | |
| 70 | Ampli-con175783 | 9763 | 327 | 330 | IND | **** | mo17 | ACGA | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 70 | Ampli-con175783 | 9764 | 476 | 476 | SNP | A | mo17 | G | b73 | | | | |
| 70 | Ampli-con175783 | 9765 | 483 | 483 | IND | * | mo17 | C | b73 | | | | |
| 71 | Ampli-con176287 | 9864 | 36 | 36 | SNP | C | mo17 | T | b73 | | | | |
| 71 | Ampli-con176287 | 9865 | 155 | 155 | SNP | A | b73 | C | mo17 | | | | |
| 71 | Ampli-con176287 | 9866 | 159 | 159 | SNP | A | mo17 | T | b73 | | | | |
| 71 | Ampli-con176287 | 9867 | 247 | 247 | SNP | A | b73 | T | mo17 | | | | |
| 72 | Ampli-con176352 | 9927 | 40 | 40 | SNP | A | mo17 | T | b73 | | | | |
| 72 | Ampli-con176352 | 10667 | 308 | 308 | SNP | A | mo17 | G | b73 | | | | |
| 73 | Ampli-con176515 | 10323 | 100 | 100 | SNP | A | b73 | G | mo17 | | | | |
| 73 | Ampli-con176515 | 10324 | 105 | 105 | SNP | A | b73 | G | mo17 | | | | |
| 73 | Ampli-con176515 | 10325 | 111 | 111 | SNP | C | b73 | G | mo17 | | | | |
| 73 | Ampli-con176515 | 10326 | 112 | 112 | SNP | C | mo17 | T | b73 | | | | |
| 73 | Ampli-con176515 | 10327 | 117 | 117 | IND | * | mo17 | C | b73 | | | | |
| 73 | Ampli-con176515 | 10328 | 119 | 120 | IND | ** | mo17 | TC | b73 | | | | |
| 73 | Ampli-con176515 | 10329 | 143 | 143 | SNP | C | mo17 | T | b73 | | | | |
| 73 | Ampli-con176515 | 10330 | 157 | 157 | SNP | C | b73 | G | mo17 | | | | |
| 73 | Ampli-con176515 | 10331 | 160 | 160 | IND | * | b73 | C | mo17 | | | | |
| 73 | Ampli-con176515 | 10332 | 174 | 175 | IND | ** | mo17 | TA | b73 | | | | |
| 73 | Ampli-con176515 | 10334 | 252 | 252 | IND | * | mo17 | C | b73 | | | | |
| 73 | Ampli-con176515 | 10335 | 269 | 269 | IND | * | b73 | C | mo17 | | | | |
| 73 | Ampli-con176515 | 10336 | 269 | 270 | IND | ** | b73 | CA | mo17 | | | | |
| 73 | Ampli-con176515 | 10337 | 417 | 422 | IND | ****** | mo17 | CAGAGA | b73 | | | | |
| 73 | Ampli-con176515 | 10338 | 462 | 462 | SNP | A | b73 | G | mo17 | | | | |
| 73 | Ampli-con176515 | 11466 | 213 | 213 | SNP | G | b73 | T | mo17 | | | | |
| 73 | Ampli-con176515 | 11472 | 320 | 320 | SNP | A | b73 | G | mo17 | | | | |
| 74 | Ampli-con176522 | 11522 | 249 | 249 | SNP | A | b73 | C | mo17 | | | | |
| 75 | Ampli-con176583 | 10618 | 162 | 162 | SNP | C | mo17 | T | b73 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 75 | Ampli-con176583 | 12012 | 128 | 128 | SNP | C | b73 | T | mo17 | | | | |
| 76 | Ampli-con176608 | 10668 | 27 | 27 | SNP | A | b73 | C | mo17 | | | | |
| 76 | Ampli-con176608 | 10669 | 46 | 46 | SNP | A | b73 | G | mo17 | | | | |
| 76 | Ampli-con176608 | 10671 | 71 | 71 | SNP | A | mo17 | C | b73 | | | | |
| 76 | Ampli-con176608 | 10673 | 227 | 227 | SNP | A | mo17 | C | b73 | | | | |
| 76 | Ampli-con176608 | 10674 | 246 | 246 | SNP | C | b73 | T | mo17 | | | | |
| 76 | Ampli-con176608 | 10675 | 283 | 283 | IND | * | b73 | T | mo17 | | | | |
| 76 | Ampli-con176608 | 10677 | 340 | 340 | SNP | A | b73 | G | mo17 | | | | |
| 77 | Ampli-con176683 | 12340 | 401 | 401 | SNP | A | mo17 | T | b73 | | | | |
| 78 | Ampli-con176749 | 11302 | 77 | 77 | SNP | A | b73 | C | mo17 | | | | |
| 78 | Ampli-con176749 | 11304 | 227 | 227 | SNP | C | b73 | G | mo17 | | | | |
| 78 | Ampli-con176749 | 11306 | 284 | 284 | SNP | A | mo17 | G | b73 | | | | |
| 78 | Ampli-con176749 | 11308 | 286 | 286 | SNP | C | mo17 | T | b73 | | | | |
| 78 | Ampli-con176749 | 11310 | 373 | 373 | SNP | A | mo17 | C | b73 | | | | |
| 78 | Ampli-con176749 | 11311 | 374 | 374 | IND | * | mo17 | C | b73 | | | | |
| 78 | Ampli-con176749 | 11313 | 393 | 393 | SNP | A | mo17 | G | b73 | | | | |
| 78 | Ampli-con176749 | 11316 | 538 | 538 | SNP | A | b73 | G | mo17 | | | | |
| 78 | Ampli-con176749 | 11318 | 609 | 609 | SNP | A | mo17 | G | b73 | | | | |
| 78 | Ampli-con176749 | 12711 | 512 | 512 | SNP | A | mo17 | G | b73 | | | | |
| 79 | Ampli-con176767 | 12824 | 411 | 411 | SNP | C | b73 | T | mo17 | | | | |
| 80 | Ampli-con176822 | 11713 | 300 | 300 | SNP | C | mo17 | G | b73 | | | | |
| 80 | Ampli-con176822 | 13100 | 286 | 286 | SNP | A | b73 | C | mo17 | | | | |
| 81 | Ampli-con176863 | 12092 | 241 | 241 | SNP | C | mo17 | T | b73 | | | | |
| 81 | Ampli-con176863 | 12093 | 297 | 298 | IND | ** | mo17 | TT | b73 | | | | |
| 81 | Ampli-con176863 | 12094 | 322 | 322 | SNP | A | b73 | G | mo17 | | | | |
| 81 | Ampli-con176863 | 12096 | 345 | 345 | SNP | A | b73 | G | mo17 | | | | |
| 81 | Ampli-con176863 | 12098 | 422 | 422 | SNP | C | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 81 | Ampli-con176863 | 13490 | 481 | 481 | SNP | C | b73 | T | mo17 | | | | |
| 82 | Ampli-con176899 | 12427 | 28 | 28 | SNP | C | mo17 | T | b73 | | | | |
| 82 | Ampli-con176899 | 12428 | 136 | 136 | SNP | G | b73 | T | mo17 | | | | |
| 82 | Ampli-con176899 | 12430 | 205 | 205 | SNP | A | mo17 | C | b73 | | | | |
| 82 | Ampli-con176899 | 12432 | 237 | 237 | SNP | C | mo17 | T | b73 | | | | |
| 82 | Ampli-con176899 | 12434 | 405 | 405 | SNP | A | b73 | G | mo17 | | | | |
| 82 | Ampli-con176899 | 13833 | 440 | 440 | SNP | A | mo17 | G | b73 | | | | |
| 83 | Ampli-con176937 | 12557 | 134 | 134 | SNP | A | b73 | G | mo17 | | | | |
| 83 | Ampli-con176937 | 12559 | 305 | 305 | SNP | A | mo17 | G | b73 | | | | |
| 83 | Ampli-con176937 | 12561 | 368 | 368 | SNP | A | b73 | G | mo17 | | | | |
| 83 | Ampli-con176937 | 12563 | 382 | 382 | IND | * | mo17 | C | b73 | | | | |
| 83 | Ampli-con176937 | 12565 | 384 | 384 | IND | * | b73 | C | mo17 | | | | |
| 83 | Ampli-con176937 | 12567 | 386 | 386 | IND | * | b73 | C | mo17 | | | | |
| 83 | Ampli-con176937 | 12569 | 388 | 388 | IND | * | b73 | C | mo17 | | | | |
| 83 | Ampli-con176937 | 12571 | 391 | 391 | SNP | A | mo17 | G | b73 | | | | |
| 83 | Ampli-con176937 | 12573 | 392 | 392 | SNP | A | mo17 | T | b73 | | | | |
| 83 | Ampli-con176937 | 12575 | 393 | 393 | SNP | G | mo17 | T | b73 | | | | |
| 84 | Ampli-con176937 | 13082 | 460 | 461 | IND | ** | b73 | TA | mo17 | | | | |
| 84 | Ampli-con177031 | 14467 | 370 | 371 | IND | ** | b73 | AT | mo17 | | | | |
| 85 | Ampli-con177031 | 13083 | 118 | 118 | SNP | A | mo17 | G | b73 | | | | |
| 85 | Ampli-con177035 | 13086 | 364 | 364 | SNP | A | mo17 | G | b73 | | | | |
| 85 | Ampli-con177035 | 13088 | 384 | 384 | SNP | A | b73 | G | mo17 | | | | |
| 86 | Ampli-con177035 | 14479 | 308 | 308 | SNP | G | mo17 | T | b73 | | | | |
| 87 | Ampli-con177038 | 13160 | 585 | 585 | SNP | C | b73 | T | mo17 | | | | |
| 87 | Ampli-con177055 | 14545 | 513 | 513 | SNP | G | b73 | T | mo17 | | | | |
| 88 | Ampli-con177055 | 13283 | 139 | 139 | SNP | A | b73 | T | mo17 | | | | |
| 88 | Ampli-con177093 | 14666 | 125 | 125 | SNP | C | mo17 | G | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 89 | Ampli-con177147 | 13685 | 230 | 230 | SNP | A | b73 | G | mo17 | | | | |
| 89 | Ampli-con177147 | 13687 | 245 | 245 | SNP | C | b73 | T | mo17 | | | | |
| 89 | Ampli-con177147 | 13688 | 300 | 300 | SNP | A | b73 | C | mo17 | | | | |
| 89 | Ampli-con177147 | 13689 | 392 | 392 | SNP | A | b73 | C | mo17 | | | | |
| 89 | Ampli-con177147 | 13691 | 489 | 489 | SNP | C | mo17 | T | b73 | | | | |
| 90 | Ampli-con177150 | 13714 | 204 | 204 | SNP | A | mo17 | G | b73 | | | | |
| 90 | Ampli-con177150 | 13716 | 224 | 224 | SNP | C | b73 | G | mo17 | | | | |
| 90 | Ampli-con177150 | 13718 | 283 | 283 | SNP | C | b73 | T | mo17 | | | | |
| 90 | Ampli-con177150 | 13720 | 424 | 424 | SNP | C | mo17 | T | b73 | | | | |
| 90 | Ampli-con177150 | 13722 | 450 | 450 | SNP | A | b73 | G | mo17 | | | | |
| 90 | Ampli-con177150 | 15096 | 397 | 397 | SNP | A | b73 | G | mo17 | | | | |
| 91 | Ampli-con177154 | 13745 | 51 | 51 | SNP | A | b73 | G | mo17 | | | | |
| 91 | Ampli-con177154 | 13747 | 71 | 71 | SNP | C | b73 | T | mo17 | | | | |
| 91 | Ampli-con177154 | 13748 | 114 | 114 | SNP | C | mo17 | T | b73 | | | | |
| 91 | Ampli-con177154 | 13750 | 152 | 152 | SNP | A | b73 | T | mo17 | | | | |
| 91 | Ampli-con177154 | 13752 | 312 | 312 | SNP | A | mo17 | G | b73 | | | | |
| 91 | Ampli-con177154 | 13754 | 449 | 449 | SNP | C | b73 | T | mo17 | | | | |
| 91 | Ampli-con177154 | 13756 | 498 | 498 | SNP | A | b73 | G | mo17 | | | | |
| 92 | Ampli-con177165 | 13783 | 66 | 66 | SNP | C | mo17 | T | b73 | | | | |
| 92 | Ampli-con177165 | 13785 | 101 | 101 | SNP | * | mo17 | | b73 | | | | |
| 92 | Ampli-con177165 | 13787 | 111 | 111 | IND | C | mo17 | T | b73 | | | | |
| 92 | Ampli-con177165 | 13791 | 143 | 143 | SNP | A | mo17 | T | b73 | | | | |
| 92 | Ampli-con177165 | 13793 | 144 | 144 | SNP | A | mo17 | T | b73 | | | | |
| 92 | Ampli-con177165 | 13795 | 190 | 190 | SNP | C | b73 | T | mo17 | | | | |
| 92 | Ampli-con177165 | 13797 | 191 | 191 | SNP | C | mo17 | G | b73 | | | | |
| 92 | Ampli-con177165 | 13799 | 193 | 193 | SNP | A | b73 | G | mo17 | | | | |
| 92 | Ampli-con177165 | 13801 | 229 | 229 | SNP | A | b73 | G | mo17 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 92 | Ampli-con171165 | 13803 | 241 | 243 | IND | *** | b73 | TAC | mo17 | | | | |
| 92 | Ampli-con171165 | 13805 | 274 | 274 | SNP | A | b73 | G | mo17 | | | | |
| 92 | Ampli-con171165 | 13807 | 334 | 334 | SNP | A | mo17 | C | b73 | | | | |
| 92 | Ampli-con171165 | 13811 | 567 | 567 | SNP | C | b73 | T | mo17 | | | | |
| 92 | Ampli-con171165 | 15184 | 390 | 390 | SNP | C | b73 | T | mo17 | | | | |
| 93 | Ampli-con171340 | 14596 | 216 | 216 | SNP | C | mo17 | C | b73 | | | | |
| 93 | Ampli-con171340 | 14599 | 502 | 502 | SNP | A | b73 | T | mo17 | | | | |
| 93 | Ampli-con171340 | 15954 | 253 | 253 | SNP | A | b73 | T | mo17 | | | | |
| 94 | Ampli-con171341 | 14602 | 67 | 67 | SNP | A | b73 | G | mo17 | | | | |
| 94 | Ampli-con171341 | 14604 | 102 | 102 | SNP | A | b73 | T | mo17 | | | | |
| 94 | Ampli-con171341 | 14606 | 187 | 187 | SNP | C | b73 | T | mo17 | | | | |
| 94 | Ampli-con171341 | 15965 | 389 | 389 | SNP | A | b73 | T | mo17 | | | | |
| 95 | Ampli-con171359 | 16041 | 189 | 189 | SNP | A | mo17 | C | b73 | | | | |
| 96 | Ampli-con171361 | 14692 | 74 | 74 | SNP | C | b73 | G | mo17 | | | | |
| 96 | Ampli-con171361 | 14694 | 104 | 104 | SNP | A | mo17 | C | b73 | | | | |
| 96 | Ampli-con171361 | 14697 | 528 | 528 | SNP | C | b73 | T | mo17 | | | | |
| 96 | Ampli-con171361 | 14698 | 556 | 556 | SNP | C | mo17 | T | b73 | | | | |
| 96 | Ampli-con171361 | 14700 | 560 | 560 | SNP | G | mo17 | T | b73 | | | | |
| 97 | Ampli-con171370 | 16074 | 384 | 384 | SNP | A | b73 | G | mo17 | | | | |
| 98 | Ampli-con171382 | 16137 | 481 | 481 | SNP | C | b73 | T | mo17 | | | | |
| 99 | Ampli-con171440 | 15165 | 229 | 229 | SNP | A | mo17 | G | b73 | | | | |
| 99 | Ampli-con171440 | 15167 | 241 | 241 | SNP | C | b73 | T | mo17 | | | | |
| 99 | Ampli-con171440 | 15171 | 411 | 411 | SNP | A | mo17 | T | b73 | | | | |
| 99 | Ampli-con171440 | 15173 | 412 | 412 | IND | * | b73 | A | mo17 | | | | |
| 99 | Ampli-con171440 | 15175 | 433 | 433 | SNP | A | b73 | G | mo17 | | | | |
| 99 | Ampli-con171440 | 15177 | 501 | 501 | SNP | A | b73 | G | mo17 | | | | |
| 99 | Ampli-con171440 | 16527 | 353 | 353 | SNP | A | b73 | T | mo17 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 100 | Ampli-con177450 | 15244 | 344 | 345 | IND | ** | b73 | AT | mo17 | | | | |
| 100 | Ampli-con177450 | 15245 | 475 | 475 | IND | * | b73 | T | mo17 | | | | |
| 100 | Ampli-con177450 | 15247 | 482 | 482 | SNP | C | mo17 | T | b73 | | | | |
| 101 | Ampli-con177463 | 15304 | 79 | 79 | SNP | A | mo17 | G | b73 | | | | |
| 101 | Ampli-con177463 | 15305 | 326 | 326 | SNP | A | mo17 | G | b73 | | | | |
| 102 | Ampli-con177482 | 15369 | 21 | 21 | SNP | G | b73 | T | mo17 | | | | |
| 102 | Ampli-con177482 | 15373 | 256 | 256 | SNP | A | mo17 | G | b73 | | | | |
| 102 | Ampli-con177482 | 16724 | 87 | 87 | SNP | C | mo17 | T | b73 | | | | |
| 103 | Ampli-con177485 | 15378 | 447 | 447 | IND | * | b73 | T | mo17 | | | | |
| 103 | Ampli-con177485 | 15379 | 455 | 455 | SNP | G | mo17 | T | b73 | | | | |
| 103 | Ampli-con177485 | 15381 | 465 | 465 | SNP | C | b73 | G | mo17 | | | | |
| 103 | Ampli-con177485 | 15383 | 503 | 503 | SNP | A | b73 | C | mo17 | | | | |
| 103 | Ampli-con177485 | 16729 | 103 | 103 | SNP | C | b73 | T | mo17 | | | | |
| 104 | Ampli-con177492 | 15405 | 81 | 84 | IND | **** | mo17 | CATG | b73 | | | | |
| 104 | Ampli-con177492 | 15407 | 136 | 136 | SNP | C | b73 | G | mo17 | | | | |
| 104 | Ampli-con177492 | 15409 | 194 | 194 | SNP | A | b73 | G | mo17 | | | | |
| 104 | Ampli-con177492 | 15411 | 275 | 275 | SNP | C | b73 | G | mo17 | | | | |
| 104 | Ampli-con177492 | 15415 | 404 | 404 | SNP | C | mo17 | T | b73 | | | | |
| 104 | Ampli-con177492 | 15417 | 532 | 532 | SNP | A | mo17 | G | b73 | | | | |
| 105 | Ampli-con177492 | 16762 | 379 | 379 | SNP | A | mo17 | C | b73 | | | | |
| 105 | Ampli-con177493 | 16767 | 61 | 61 | SNP | A | mo17 | C | b73 | | | | |
| 106 | Ampli-con177524 | 15604 | 141 | 141 | SNP | A | mo17 | G | b73 | | | | |
| 106 | Ampli-con177524 | 16944 | 231 | 231 | SNP | A | b73 | T | mo17 | | | | |
| 107 | Ampli-con177615 | 16016 | 112 | 112 | SNP | C | b73 | T | mo17 | | | | |
| 107 | Ampli-con177615 | 16017 | 158 | 158 | SNP | A | mo17 | T | b73 | | | | |
| 107 | Ampli-con177615 | 16019 | 286 | 286 | SNP | A | b73 | G | mo17 | | | | |
| 107 | Ampli-con177615 | 16021 | 288 | 288 | SNP | A | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 107 | Ampli-con177615 | 16023 | 295 | 295 | SNP | A | b73 | G | mo17 | | | | |
| 107 | Ampli-con177615 | 16024 | 334 | 334 | SNP | C | b73 | T | mo17 | | | | |
| 107 | Ampli-con177615 | 16026 | 381 | 381 | SNP | A | b73 | G | mo17 | | | | |
| 108 | Ampli-con177707 | 16497 | 125 | 125 | SNP | A | b73 | G | mo17 | | | | |
| 108 | Ampli-con177707 | 17828 | 340 | 340 | SNP | A | mo17 | G | b73 | | | | |
| 109 | Ampli-con177729 | 16576 | 63 | 63 | SNP | C | mo17 | T | b73 | | | | |
| 109 | Ampli-con177729 | 16578 | 83 | 83 | SNP | A | mo17 | T | b73 | | | | |
| 109 | Ampli-con177729 | 16582 | 208 | 208 | SNP | G | mo17 | T | b73 | | | | |
| 109 | Ampli-con177729 | 16584 | 248 | 248 | SNP | C | mo17 | T | b73 | | | | |
| 109 | Ampli-con177729 | 16585 | 250 | 253 | IND | **** | b73 | GGAC | mo17 | | | | |
| 109 | Ampli-con177729 | 16588 | 331 | 331 | SNP | G | mo17 | T | b73 | | | | |
| 109 | Ampli-con177729 | 16589 | 377 | 377 | SNP | G | mo17 | T | b73 | | | | |
| 109 | Ampli-con177729 | 16591 | 391 | 391 | SNP | A | b73 | T | mo17 | | | | |
| 109 | Ampli-con177729 | 16593 | 397 | 397 | SNP | C | b73 | T | mo17 | | | | |
| 109 | Ampli-con177729 | 16595 | 398 | 398 | IND | * | mo17 | T | b73 | | | | |
| 109 | Ampli-con177729 | 17900 | 155 | 155 | SNP | A | mo17 | G | b73 | | | | |
| 109 | Ampli-con177729 | 17908 | 256 | 259 | IND | **** | b73 | CTGG | mo17 | | | | |
| 110 | Ampli-con177761 | 16726 | 150 | 150 | SNP | A | b73 | G | mo17 | | | | |
| 110 | Ampli-con177761 | 16727 | 152 | 152 | SNP | A | mo17 | G | b73 | | | | |
| 110 | Ampli-con177761 | 16728 | 184 | 184 | SNP | C | b73 | T | mo17 | | | | |
| 110 | Ampli-con177761 | 16730 | 302 | 302 | SNP | A | mo17 | G | b73 | | | | |
| 111 | Ampli-con177766 | 16752 | 26 | 26 | SNP | C | mo17 | T | b73 | | | | |
| 111 | Ampli-con177766 | 16753 | 59 | 59 | SNP | C | mo17 | G | b73 | | | | |
| 111 | Ampli-con177766 | 16755 | 140 | 140 | SNP | C | mo17 | T | b73 | | | | |
| 111 | Ampli-con177766 | 16757 | 229 | 229 | SNP | C | b73 | T | mo17 | | | | |
| 111 | Ampli-con177766 | 16759 | 239 | 239 | SNP | C | mo17 | G | b73 | | | | |
| 111 | Ampli-con177766 | 16761 | 242 | 242 | SNP | A | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 111 | Ampli-con177766 | 16763 | 265 | 265 | SNP | G | b73 | T | mo17 | | | | |
| 112 | Ampli-con177785 | 16839 | 146 | 146 | SNP | A | mo17 | C | b73 | | | | |
| 112 | Ampli-con177785 | 18157 | 576 | 576 | SNP | C | b73 | T | mo17 | | | | |
| 113 | Ampli-con177791 | 16876 | 90 | 90 | SNP | A | mo17 | G | b73 | | | | |
| 113 | Ampli-con177791 | 16877 | 108 | 112 | IND | ***** | mo17 | AGTAC | b73 | | | | |
| 113 | Ampli-con177791 | 16878 | 197 | 197 | SNP | C | b73 | G | mo17 | | | | |
| 113 | Ampli-con177791 | 16880 | 199 | 200 | IND | ** | b73 | CA | mo17 | | | | |
| 113 | Ampli-con177791 | 16882 | 202 | 202 | SNP | G | mo17 | T | b73 | | | | |
| 113 | Ampli-con177791 | 16883 | 205 | 205 | SNP | A | b73 | G | mo17 | | | | |
| 113 | Ampli-con177791 | 16885 | 206 | 206 | SNP | C | b73 | G | mo17 | | | | |
| 113 | Ampli-con177791 | 16887 | 209 | 210 | IND | ** | b73 | CG | mo17 | | | | |
| 113 | Ampli-con177791 | 16889 | 214 | 215 | IND | ** | b73 | AA | mo17 | | | | |
| 113 | Ampli-con177791 | 16891 | 218 | 218 | IND | * | b73 | A | mo17 | | | | |
| 113 | Ampli-con177791 | 16893 | 220 | 220 | IND | * | b73 | T | mo17 | | | | |
| 113 | Ampli-con177791 | 16895 | 259 | 259 | SNP | A | mo17 | C | b73 | | | | |
| 114 | Ampli-con177843 | 17079 | 516 | 516 | SNP | C | b73 | G | mo17 | | | | |
| 114 | Ampli-con177843 | 18392 | 356 | 356 | SNP | A | b73 | T | mo17 | | | | |
| 115 | Ampli-con177848 | 17120 | 150 | 150 | SNP | A | mo17 | G | b73 | | | | |
| 115 | Ampli-con177848 | 18439 | 171 | 171 | SNP | A | b73 | G | mo17 | | | | |
| 116 | Ampli-con178002 | 17897 | 336 | 336 | SNP | A | b73 | G | mo17 | | | | |
| 116 | Ampli-con178002 | 19198 | 322 | 322 | SNP | C | mo17 | T | b73 | | | | |
| 117 | Ampli-con178141 | 18677 | 919 | 919 | SNP | C | b73 | T | mo17 | | | | |
| 117 | Ampli-con178141 | 18679 | 921 | 921 | SNP | C | mo17 | T | b73 | | | | |
| 117 | Ampli-con178141 | 18681 | 1033 | 1033 | SNP | C | mo17 | T | b73 | | | | |
| 117 | Ampli-con178141 | 18683 | 1087 | 1087 | SNP | A | b73 | G | mo17 | | | | |
| 117 | Ampli-con178141 | 18685 | 1099 | 1099 | SNP | A | mo17 | T | b73 | | | | |
| 117 | Ampli-con178141 | 18689 | 1223 | 1223 | SNP | C | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 117 | Ampli-con178141 | 19963 | 1174 | 1174 | SNP | A | b73 | C | mo17 | | | | |
| 118 | Ampli-con178159 | 20048 | 415 | 415 | SNP | A | b73 | G | mo17 | | | | |
| 119 | Ampli-con178261 | 19236 | 152 | 152 | SNP | A | mo17 | G | b73 | | | | |
| 119 | Ampli-con178261 | 19240 | 243 | 243 | SNP | A | mo17 | G | b73 | | | | |
| 119 | Ampli-con178261 | 19241 | 245 | 245 | SNP | G | mo17 | T | b73 | | | | |
| 119 | Ampli-con178261 | 19242 | 406 | 406 | SNP | C | b73 | T | mo17 | | | | |
| 120 | Ampli-con178261 | 20502 | 171 | 171 | SNP | A | b73 | G | mo17 | | | | |
| 120 | Ampli-con178278 | 19266 | 113 | 113 | SNP | G | b73 | T | b73 | | | | |
| 120 | Ampli-con178278 | 19268 | 114 | 116 | IND | *** | mo17 | GAG | b73 | | | | |
| 120 | Ampli-con178278 | 19271 | 158 | 158 | SNP | A | mo17 | G | mo17 | | | | |
| 120 | Ampli-con178278 | 20537 | 139 | 139 | SNP | C | b73 | T | b73 | | | | |
| 121 | Ampli-con178389 | 19661 | 48 | 48 | SNP | G | mo17 | T | mo17 | | | | |
| 121 | Ampli-con178389 | 19663 | 338 | 338 | SNP | C | mo17 | T | b73 | | | | |
| 121 | Ampli-con178389 | 20933 | 372 | 372 | SNP | C | mo17 | T | b73 | | | | |
| 122 | Ampli-con178389 | 19669 | 299 | 299 | SNP | A | b73 | C | mo17 | | | | |
| 122 | Ampli-con178390 | 20934 | 172 | 172 | SNP | A | mo17 | G | b73 | | | | |
| 123 | Ampli-con178390 | 19702 | 81 | 81 | SNP | G | mo17 | T | mo17 | | | | |
| 123 | Ampli-con178392 | 19704 | 182 | 182 | SNP | A | b73 | T | mo17 | | | | |
| 123 | Ampli-con178392 | 19705 | 402 | 402 | IND | * | b73 | A | mo17 | | | | |
| 124 | Ampli-con178392 | 19767 | 38 | 38 | SNP | G | mo17 | T | b73 | | | | |
| 124 | Ampli-con178401 | 19771 | 178 | 178 | SNP | G | mo17 | T | b73 | | | | |
| 124 | Ampli-con178401 | 19773 | 193 | 193 | SNP | A | mo17 | C | b73 | | | | |
| 124 | Ampli-con178401 | 19775 | 205 | 210 | IND | ****** | b73 | GGAGAG | mo17 | | | | |
| 124 | Ampli-con178401 | 19777 | 219 | 223 | IND | ***** | b73 | AAAAA | mo17 | | | | |
| 124 | Ampli-con178401 | 19782 | 420 | 420 | SNP | C | mo17 | T | b73 | | | | |
| 124 | Ampli-con178401 | 19784 | 428 | 428 | SNP | A | b73 | G | mo17 | | | | |
| 124 | Ampli-con178401 | 21038 | 125 | 125 | SNP | A | mo17 | T | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 124 | Ampli-con178401 | 21045 | 307 | 307 | SNP | C | b73 | T | mo17 | | | | |
| 125 | Ampli-con178430 | 19893 | 113 | 113 | SNP | G | mo17 | T | b73 | | | | |
| 125 | Ampli-con178430 | 19896 | 239 | 239 | SNP | A | mo17 | C | b73 | | | | |
| 125 | Ampli-con178430 | 19897 | 465 | 465 | SNP | C | b73 | T | mo17 | | | | |
| 126 | Ampli-con178454 | 21154 | 54 | 54 | SNP | C | b73 | T | mo17 | | | | |
| 126 | Ampli-con178454 | 20172 | 157 | 157 | SNP | C | mo17 | T | b73 | | | | |
| 126 | Ampli-con178454 | 20173 | 172 | 172 | SNP | C | b73 | G | mo17 | | | | |
| 126 | Ampli-con178454 | 20175 | 194 | 194 | SNP | G | b73 | T | mo17 | | | | |
| 126 | Ampli-con178454 | 20177 | 203 | 203 | SNP | A | mo17 | C | b73 | | | | |
| 126 | Ampli-con178454 | 20180 | 296 | 296 | SNP | A | b73 | C | mo17 | | | | |
| 126 | Ampli-con178454 | 20182 | 297 | 297 | SNP | C | b73 | T | mo17 | | | | |
| 126 | Ampli-con178454 | 20184 | 335 | 335 | SNP | A | b73 | C | mo17 | | | | |
| 126 | Ampli-con178454 | 20187 | 367 | 367 | SNP | G | b73 | T | mo17 | | | | |
| 126 | Ampli-con178454 | 20189 | 371 | 371 | SNP | A | mo17 | G | b73 | | | | |
| 126 | Ampli-con178454 | 20191 | 402 | 402 | SNP | A | mo17 | C | b73 | | | | |
| 126 | Ampli-con178454 | 21433 | 59 | 59 | SNP | C | mo17 | G | b73 | | | | |
| 126 | Ampli-con178454 | 21443 | 223 | 223 | SNP | A | b73 | G | mo17 | | | | |
| 127 | Ampli-con178494 | 20348 | 303 | 303 | SNP | C | b73 | T | b73 | | | | |
| 127 | Ampli-con178494 | 20350 | 391 | 391 | SNP | A | b73 | T | mo17 | | | | |
| 127 | Ampli-con178494 | 21603 | 180 | 180 | SNP | G | b73 | T | mo17 | | | | |
| 128 | Ampli-con178507 | 20406 | 52 | 52 | SNP | C | mo17 | G | b73 | | | | |
| 128 | Ampli-con178507 | 20408 | 219 | 219 | SNP | G | mo17 | T | b73 | | | | |
| 128 | Ampli-con178507 | 20410 | 283 | 283 | SNP | A | b73 | T | mo17 | | | | |
| 128 | Ampli-con178507 | 20412 | 294 | 294 | SNP | G | mo17 | T | b73 | | | | |
| 128 | Ampli-con178507 | 20414 | 359 | 359 | SNP | A | mo17 | G | b73 | | | | |
| 128 | Ampli-con178507 | 20416 | 396 | 396 | SNP | A | mo17 | G | b73 | | | | |
| 128 | Ampli-con178507 | 20418 | 397 | 397 | SNP | G | mo17 | T | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 128 | Ampli-con178507 | 20420 | 429 | 429 | SNP | C | b73 | T | mo17 | | | | |
| 128 | Ampli-con178507 | 20422 | 432 | 432 | SNP | C | b73 | G | mo17 | | | | |
| 128 | Ampli-con178507 | 20424 | 457 | 457 | SNP | C | b73 | T | mo17 | | | | |
| 128 | Ampli-con178507 | 20426 | 462 | 462 | SNP | G | mo17 | T | b73 | | | | |
| 129 | Ampli-con178546 | 20513 | 147 | 147 | SNP | A | b73 | C | mo17 | | | | |
| 129 | Ampli-con178546 | 20515 | 180 | 180 | SNP | C | b73 | T | mo17 | | | | |
| 129 | Ampli-con178546 | 20517 | 312 | 312 | SNP | C | mo17 | T | b73 | | | | |
| 129 | Ampli-con178546 | 20519 | 336 | 336 | SNP | A | b73 | C | mo17 | | | | |
| 129 | Ampli-con178546 | 20521 | 342 | 342 | SNP | C | b73 | T | mo17 | | | | |
| 129 | Ampli-con178546 | 20523 | 396 | 396 | SNP | C | b73 | T | mo17 | | | | |
| 129 | Ampli-con178546 | 20525 | 435 | 435 | SNP | C | mo17 | T | b73 | | | | |
| 129 | Ampli-con178546 | 21772 | 258 | 258 | SNP | C | b73 | T | mo17 | | | | |
| 130 | Ampli-con178546 | 21895 | 37 | 37 | SNP | C | b73 | T | mo17 | | | | |
| 131 | Ampli-con178569 | 21190 | 285 | 285 | SNP | A | b73 | G | mo17 | | | | |
| 131 | Ampli-con178666 | 21192 | 498 | 498 | SNP | C | mo17 | T | b73 | | | | |
| 132 | Ampli-con178666 | 21292 | 130 | 130 | SNP | C | mo17 | T | b73 | | | | |
| 133 | Ampli-con178673 | 22541 | 130 | 130 | SNP | C | mo17 | T | b73 | | | | |
| 134 | Ampli-con178674 | 22717 | 63 | 63 | SNP | A | mo17 | T | b73 | | | | |
| 135 | Ampli-con178700 | 21524 | 115 | 115 | IND | * | mo17 | T | b73 | | | | |
| 135 | Ampli-con178723 | 21526 | 117 | 117 | IND | * | mo17 | A | b73 | | | | |
| 135 | Ampli-con178723 | 21528 | 209 | 215 | IND | ******* | b73 | AGCTAGC | mo17 | | | | |
| 135 | Ampli-con178723 | 21530 | 217 | 217 | IND | * | b73 | T | mo17 | | | | |
| 135 | Ampli-con178723 | 21532 | 481 | 481 | SNP | C | mo17 | T | b73 | | | | |
| 135 | Ampli-con178723 | 21533 | 485 | 485 | SNP | C | mo17 | G | b73 | | | | |
| 135 | Ampli-con178723 | 21535 | 487 | 487 | SNP | C | b73 | G | mo17 | | | | |
| 135 | Ampli-con178723 | 21536 | 488 | 488 | IND | * | mo17 | T | b73 | | | | |
| 135 | Ampli-con178723 | 21539 | 490 | 490 | SNP | C | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 135 | Ampli-con178723 | 21541 | 496 | 496 | SNP | A | mo17 | T | b73 | | | | |
| 135 | Ampli-con178723 | 21543 | 500 | 501 | IND | ** | mo17 | GC | b73 | | | | |
| 135 | Ampli-con178723 | 21545 | 503 | 503 | SNP | A | b73 | G | mo17 | | | | |
| 135 | Ampli-con178723 | 22775 | 526 | 526 | SNP | A | mo17 | G | b73 | | | | |
| 136 | Ampli-con178723 | 21564 | 163 | 163 | SNP | C | mo17 | T | b73 | | | | |
| 136 | Ampli-con178726 | 22796 | 198 | 198 | SNP | A | mo17 | G | b73 | | | | |
| 137 | Ampli-con178726 | 23091 | 169 | 169 | SNP | G | b73 | T | mo17 | | | | |
| 138 | Ampli-con178785 | 23289 | 250 | 250 | SNP | A | b73 | G | mo17 | | | | |
| 139 | Ampli-con178833 | 23779 | 342 | 342 | SNP | A | mo17 | G | b73 | | | | |
| 140 | Ampli-con178895 | 23075 | 54 | 54 | SNP | A | mo17 | T | b73 | | | | |
| 140 | Ampli-con179006 | 23078 | 224 | 224 | SNP | A | mo17 | G | b73 | | | | |
| 140 | Ampli-con179006 | 23080 | 306 | 306 | SNP | A | b73 | G | mo17 | | | | |
| 140 | Ampli-con179006 | 23082 | 329 | 329 | IND | * | mo17 | C | b73 | | | | |
| 140 | Ampli-con179006 | 23085 | 342 | 342 | SNP | A | b73 | G | mo17 | | | | |
| 140 | Ampli-con179006 | 23086 | 363 | 363 | SNP | C | mo17 | T | b73 | | | | |
| 140 | Ampli-con179006 | 23087 | 390 | 390 | SNP | A | b73 | C | mo17 | | | | |
| 140 | Ampli-con179006 | 23089 | 503 | 503 | SNP | A | b73 | T | mo17 | | | | |
| 140 | Ampli-con179006 | 24265 | 136 | 136 | SNP | A | mo17 | G | b73 | | | | |
| 141 | Ampli-con179006 | 23203 | 38 | 40 | IND | *** | mo17 | TCA | b73 | | | | |
| 141 | Ampli-con179027 | 23207 | 282 | 282 | SNP | C | b73 | G | mo17 | | | | |
| 141 | Ampli-con179027 | 24395 | 76 | 76 | SNP | C | b73 | T | mo17 | | | | |
| 142 | Ampli-con179027 | 24422 | 45 | 45 | SNP | C | mo17 | T | b73 | | | | |
| 143 | Ampli-con179035 | 23438 | 32 | 32 | SNP | A | mo17 | C | b73 | | | | |
| 143 | Ampli-con179070 | 23440 | 71 | 71 | SNP | A | b73 | T | mo17 | | | | |
| 143 | Ampli-con179070 | 23442 | 353 | 353 | SNP | C | mo17 | G | b73 | | | | |
| 144 | Ampli-con179140 | 23820 | 41 | 41 | SNP | C | mo17 | G | b73 | | | | |
| 144 | Ampli-con179140 | 23822 | 50 | 50 | IND | * | b73 | G | mo17 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 144 | Ampli-con179140 | 25000 | 72 | 72 | SNP | A | mo17 | G | b73 | | | | |
| 145 | Ampli-con179151 | 23890 | 120 | 120 | SNP | C | b73 | T | mo17 | | | | |
| 145 | Ampli-con179151 | 23892 | 476 | 476 | SNP | C | mo17 | T | b73 | | | | |
| 146 | Ampli-con179283 | 24647 | 190 | 190 | SNP | A | b73 | G | mo17 | | | | |
| 146 | Ampli-con179283 | 24649 | 265 | 265 | SNP | A | mo17 | G | b73 | | | | |
| 146 | Ampli-con179283 | 24651 | 375 | 375 | SNP | C | b73 | T | mo17 | | | | |
| 146 | Ampli-con179283 | 24653 | 431 | 431 | SNP | A | b73 | G | mo17 | | | | |
| 147 | Ampli-con179301 | 24693 | 92 | 92 | SNP | A | b73 | G | mo17 | | | | |
| 147 | Ampli-con179301 | 24697 | 201 | 201 | SNP | C | b73 | T | mo17 | | | | |
| 147 | Ampli-con179301 | 24699 | 245 | 245 | SNP | C | b73 | T | mo17 | | | | |
| 147 | Ampli-con179301 | 24701 | 272 | 272 | SNP | C | b73 | T | mo17 | | | | |
| 147 | Ampli-con179301 | 24703 | 395 | 395 | SNP | A | b73 | G | mo17 | | | | |
| 147 | Ampli-con179301 | 24704 | 418 | 418 | SNP | C | mo17 | T | b73 | | | | |
| 147 | Ampli-con179301 | 24705 | 505 | 505 | SNP | C | mo17 | T | b73 | | | | |
| 148 | Ampli-con179301 | 25863 | 128 | 128 | SNP | A | mo17 | G | b73 | | | | |
| 149 | Ampli-con179301 | 25961 | 399 | 399 | SNP | A | b73 | G | mo17 | | | | |
| 149 | Ampli-con179323 | 25414 | 23 | 23 | SNP | A | mo17 | G | b73 | | | | |
| 149 | Ampli-con179392 | 25416 | 212 | 212 | SNP | A | mo17 | G | b73 | | | | |
| 149 | Ampli-con179392 | 25418 | 224 | 226 | IND | *** | mo17 | ATC | b73 | | | | |
| 150 | Ampli-con179392 | 26846 | 467 | 467 | SNP | A | b73 | C | mo17 | | | | |
| 151 | Ampli-con179414 | 26151 | 183 | 183 | SNP | C | mo17 | T | b73 | | | | |
| 151 | Ampli-con179487 | 26153 | 207 | 209 | IND | *** | mo17 | CGG | b73 | | | | |
| 151 | Ampli-con179487 | 26155 | 212 | 213 | IND | ** | mo17 | AC | b73 | | | | |
| 151 | Ampli-con179487 | 26157 | 215 | 216 | IND | ** | mo17 | CC | b73 | | | | |
| 151 | Ampli-con179487 | 26159 | 236 | 236 | IND | * | mo17 | G | b73 | | | | |
| 151 | Ampli-con179487 | 26163 | 306 | 306 | SNP | C | b73 | T | mo17 | | | | |
| 151 | Ampli-con179487 | 26165 | 339 | 339 | SNP | A | b73 | T | mo17 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 151 | Ampli-con179487 | 26167 | 407 | 407 | SNP | A | mo17 | C | b73 | | | | |
| 151 | Ampli-con179487 | 26169 | 408 | 408 | SNP | A | mo17 | C | b73 | | | | |
| 151 | Ampli-con179487 | 26171 | 409 | 409 | SNP | A | b73 | G | mo17 | | | | |
| 151 | Ampli-con179487 | 27295 | 279 | 279 | SNP | A | mo17 | G | b73 | | | | |
| 152 | Ampli-con179497 | 26233 | 118 | 118 | SNP | C | b73 | G | mo17 | | | | |
| 152 | Ampli-con179497 | 26235 | 167 | 167 | SNP | A | mo17 | G | b73 | | | | |
| 152 | Ampli-con179497 | 26237 | 178 | 178 | SNP | A | b73 | G | mo17 | | | | |
| 152 | Ampli-con179497 | 26239 | 287 | 287 | SNP | A | b73 | G | mo17 | | | | |
| 152 | Ampli-con179497 | 26241 | 370 | 370 | SNP | G | b73 | T | mo17 | | | | |
| 152 | Ampli-con179497 | 26243 | 423 | 423 | SNP | G | mo17 | T | b73 | | | | |
| 152 | Ampli-con179497 | 26245 | 433 | 433 | SNP | A | mo17 | G | b73 | | | | |
| 152 | Ampli-con179497 | 26247 | 462 | 462 | SNP | C | mo17 | T | b73 | | | | |
| 152 | Ampli-con179497 | 27375 | 478 | 478 | SNP | A | b73 | C | mo17 | | | | |
| 153 | Ampli-con179515 | 26314 | 16 | 16 | SNP | A | b73 | G | mo17 | | | | |
| 153 | Ampli-con179515 | 26316 | 33 | 33 | IND | * | b73 | A | mo17 | | | | |
| 153 | Ampli-con179515 | 26318 | 95 | 95 | SNP | A | mo17 | G | b73 | | | | |
| 153 | Ampli-con179515 | 26319 | 132 | 132 | SNP | A | b73 | G | mo17 | | | | |
| 153 | Ampli-con179515 | 26321 | 161 | 161 | SNP | C | mo17 | G | b73 | | | | |
| 153 | Ampli-con179515 | 26322 | 281 | 283 | IND | *** | b73 | CTG | mo17 | | | | |
| 153 | Ampli-con179515 | 26326 | 351 | 351 | SNP | A | mo17 | C | b73 | | | | |
| 153 | Ampli-con179515 | 27447 | 310 | 310 | SNP | C | mo17 | G | b73 | | | | |
| 154 | Ampli-con179595 | 26711 | 30 | 30 | SNP | C | mo17 | T | b73 | | | | |
| 154 | Ampli-con179595 | 26713 | 51 | 51 | SNP | A | b73 | C | mo17 | | | | |
| 154 | Ampli-con179595 | 26715 | 155 | 155 | IND | * | mo17 | T | b73 | | | | |
| 154 | Ampli-con179595 | 26717 | 187 | 187 | SNP | C | mo17 | T | b73 | | | | |
| 154 | Ampli-con179595 | 26719 | 194 | 194 | SNP | C | b73 | G | mo17 | | | | |
| 154 | Ampli-con179595 | 26720 | 213 | 213 | SNP | A | b73 | C | mo17 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 154 | Ampli-con179595 | 26722 | 233 | 233 | SNP | C | b73 | T | mo17 | | | | |
| 154 | Ampli-con179595 | 26723 | 285 | 285 | SNP | C | mo17 | T | b73 | | | | |
| 154 | Ampli-con179595 | 26725 | 395 | 395 | SNP | G | mo17 | T | b73 | | | | |
| 155 | Ampli-con179720 | 27268 | 249 | 249 | SNP | A | b73 | G | mo17 | | | | |
| 155 | Ampli-con179720 | 27272 | 336 | 336 | SNP | A | b73 | T | mo17 | | | | |
| 155 | Ampli-con179720 | 27274 | 355 | 355 | SNP | A | b73 | G | mo17 | | | | |
| 155 | Ampli-con179720 | 27276 | 357 | 357 | IND | * | mo17 | C | b73 | | | | |
| 155 | Ampli-con179720 | 27278 | 368 | 368 | SNP | C | b73 | G | mo17 | | | | |
| 156 | Ampli-con179741 | 28164 | 267 | 267 | SNP | C | mo17 | G | b73 | | | | |
| 156 | Ampli-con179741 | 27359 | 20 | 20 | SNP | A | mo17 | G | b73 | | | | |
| 156 | Ampli-con179741 | 27360 | 218 | 218 | SNP | C | mo17 | G | b73 | | | | |
| 156 | Ampli-con179741 | 27361 | 228 | 228 | SNP | C | mo17 | T | b73 | | | | |
| 156 | Ampli-con179741 | 27363 | 459 | 459 | SNP | A | b73 | G | mo17 | | | | |
| 157 | Ampli-con179806 | 27613 | 32 | 32 | SNP | * | mo17 | T | b73 | | | | |
| 157 | Ampli-con179806 | 27615 | 235 | 235 | IND | C | b73 | T | mo17 | | | | |
| 158 | Ampli-con179806 | 27874 | 345 | 345 | SNP | * | b73 | C | mo17 | | | | |
| 159 | Ampli-con179868 | 28913 | 103 | 103 | IND | * | mo17 | C | b73 | | | | |
| 159 | Ampli-con234986 | 28914 | 149 | 149 | IND | ** | mo17 | C* | b73 | | | | |
| 159 | Ampli-con234986 | 28915 | 149 | 150 | IND | A | b73 | G | mo17 | | | | |
| 159 | Ampli-con234986 | 28916 | 169 | 169 | SNP | A | b73 | C | mo17 | | | | |
| 159 | Ampli-con234986 | 28917 | 256 | 256 | SNP | C | b73 | G | mo17 | | | | |
| 159 | Ampli-con234986 | 28918 | 311 | 311 | SNP | G | b73 | T | mo17 | | | | |
| 159 | Ampli-con234986 | 28919 | 469 | 469 | SNP | A | mo17 | G | b73 | | | | |
| 159 | Ampli-con234986 | 28920 | 501 | 501 | SNP | A | b73 | T | mo17 | | | | |
| 159 | Ampli-con234986 | 28921 | 834 | 834 | SNP | A | mo17 | T | b73 | | | | |
| 159 | Ampli-con234986 | 28922 | 911 | 911 | SNP | A | b73 | G | mo17 | | | | |
| 159 | Ampli-con234986 | 28923 | 1056 | 1056 | SNP | C | b73 | G | mo17 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 160 | Ampli-con234993 | 28931 | 175 | 175 | IND | * | mo17 | A | b73 | | | | |
| 160 | Ampli-con234993 | 28932 | 1103 | 1103 | SNP | A | mo17 | G | b73 | | | | |
| 161 | Ampli-con234996 | 28933 | 354 | 354 | SNP | A | mo17 | C | b73 | | | | |
| 161 | Ampli-con234996 | 28934 | 555 | 555 | SNP | C | mo17 | T | b73 | | | | |
| 161 | Ampli-con234996 | 28935 | 593 | 593 | SNP | A | mo17 | G | b73 | | | | |
| 162 | Ampli-con235018 | 29005 | 243 | 243 | SNP | A | b73 | G | mo17 | | | | |
| 163 | Ampli-con235123 | 29193 | 287 | 287 | IND | * | mo17 | C | b73 | | | | |
| 163 | Ampli-con235123 | 29194 | 291 | 291 | SNP | A | b73 | G | mo17 | | | | |
| 163 | Ampli-con235123 | 29195 | 673 | 678 | IND | ****** | mo17 | GCATTA | b73 | | | | |
| 163 | Ampli-con235123 | 29196 | 757 | 757 | SNP | A | b73 | G | mo17 | | | | |
| 164 | Ampli-con235210 | 29362 | 105 | 105 | SNP | C | b73 | T | mo17 | | | | |
| 164 | Ampli-con235210 | 29363 | 135 | 135 | SNP | A | b73 | G | mo17 | | | | |
| 164 | Ampli-con235210 | 29364 | 145 | 145 | SNP | C | b73 | G | mo17 | | | | |
| 164 | Ampli-con235210 | 29365 | 168 | 168 | SNP | A | mo17 | G | b73 | | | | |
| 164 | Ampli-con235210 | 29366 | 207 | 207 | IND | * | mo17 | C | b73 | | | | |
| 164 | Ampli-con235210 | 29367 | 218 | 218 | SNP | A | b73 | G | mo17 | | | | |
| 164 | Ampli-con235210 | 29368 | 225 | 225 | SNP | C | b73 | T | mo17 | | | | |
| 164 | Ampli-con235210 | 29369 | 275 | 275 | SNP | C | mo17 | T | b73 | | | | |
| 164 | Ampli-con235210 | 29370 | 283 | 283 | SNP | A | b73 | C | mo17 | | | | |
| 164 | Ampli-con235210 | 29371 | 392 | 392 | SNP | G | mo17 | T | b73 | | | | |
| 164 | Ampli-con235210 | 29372 | 406 | 406 | SNP | A | mo17 | G | b73 | | | | |
| 164 | Ampli-con235210 | 29373 | 418 | 418 | SNP | A | b73 | G | mo17 | | | | |
| 164 | Ampli-con235210 | 29374 | 422 | 422 | IND | * | mo17 | A | b73 | | | | |
| 164 | Ampli-con235210 | 29375 | 433 | 433 | SNP | A | b73 | G | mo17 | | | | |
| 164 | Ampli-con235210 | 29376 | 434 | 434 | SNP | A | b73 | G | mo17 | | | | |
| 164 | Ampli-con235210 | 29377 | 441 | 441 | IND | * | mo17 | A | b73 | | | | |
| 165 | Ampli-con235220 | 29390 | 302 | 302 | SNP | C | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 166 | Ampli-con235234 | 29435 | 555 | 555 | SNP | A | b73 | G | mo17 | | | | |
| 167 | Ampli-con235395 | 29745 | 1024 | 1024 | SNP | C | b73 | G | mo17 | | | | |
| 167 | Ampli-con235395 | 29746 | 1061 | 1061 | SNP | C | mo17 | T | b73 | | | | |
| 167 | Ampli-con235395 | 29747 | 1143 | 1143 | SNP | A | mo17 | G | b73 | | | | |
| 167 | Ampli-con235395 | 29748 | 1166 | 1166 | IND | * | b73 | A | mo17 | | | | |
| 168 | Ampli-con235410 | 29779 | 83 | 83 | SNP | A | b73 | T | mo17 | | | | |
| 168 | Ampli-con235410 | 29780 | 140 | 140 | SNP | C | mo17 | T | b73 | | | | |
| 168 | Ampli-con235410 | 29781 | 211 | 213 | IND | *** | mo17 | GCT | b73 | | | | |
| 168 | Ampli-con235410 | 29782 | 313 | 313 | SNP | A | b73 | G | mo17 | | | | |
| 168 | Ampli-con235410 | 29783 | 315 | 315 | SNP | C | mo17 | T | b73 | | | | |
| 169 | Ampli-con235434 | 29819 | 64 | 64 | SNP | A | b73 | T | mo17 | | | | |
| 169 | Ampli-con235434 | 29820 | 108 | 108 | SNP | A | mo17 | G | b73 | | | | |
| 169 | Ampli-con235434 | 29821 | 120 | 120 | SNP | A | b73 | G | mo17 | | | | |
| 169 | Ampli-con235434 | 29822 | 121 | 121 | SNP | C | mo17 | T | b73 | | | | |
| 169 | Ampli-con235434 | 29823 | 180 | 180 | SNP | A | b73 | G | mo17 | | | | |
| 169 | Ampli-con235434 | 29824 | 186 | 186 | SNP | A | mo17 | C | b73 | | | | |
| 169 | Ampli-con235434 | 29825 | 202 | 202 | SNP | A | b73 | G | mo17 | | | | |
| 169 | Ampli-con235434 | 29826 | 210 | 210 | SNP | C | b73 | T | mo17 | | | | |
| 169 | Ampli-con235434 | 29827 | 215 | 215 | SNP | A | mo17 | G | b73 | | | | |
| 170 | Ampli-con235438 | 29829 | 161 | 161 | SNP | C | b73 | T | mo17 | | | | |
| 171 | Ampli-con235446 | 29832 | 136 | 136 | SNP | C | mo17 | G | b73 | | | | |
| 171 | Ampli-con235446 | 29833 | 247 | 247 | SNP | A | b73 | G | mo17 | | | | |
| 171 | Ampli-con235446 | 29834 | 255 | 255 | SNP | A | b73 | G | mo17 | | | | |
| 171 | Ampli-con235446 | 29835 | 303 | 303 | SNP | C | mo17 | T | b73 | | | | |
| 171 | Ampli-con235446 | 29836 | 304 | 304 | SNP | A | b73 | G | mo17 | | | | |
| 171 | Ampli-con235446 | 29837 | 435 | 435 | SNP | C | mo17 | T | b73 | | | | |
| 171 | Ampli-con235446 | 29838 | 501 | 511 | IND | ********** | mo17 | GTATATATATT | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 172 | Ampli-con235447 | 29839 | 101 | 101 | SNP | C | mo17 | G | b73 | | | | |
| 172 | Ampli-con235447 | 29840 | 106 | 106 | SNP | C | b73 | T | mo17 | | | | |
| 172 | Ampli-con235447 | 29841 | 107 | 107 | SNP | A | mo17 | T | b73 | | | | |
| 172 | Ampli-con235447 | 29842 | 260 | 260 | SNP | A | b73 | G | mo17 | | | | |
| 172 | Ampli-con235447 | 29843 | 285 | 285 | SNP | A | b73 | G | mo17 | | | | |
| 172 | Ampli-con235447 | 29844 | 286 | 286 | IND | * | mo17 | A | b73 | | | | |
| 172 | Ampli-con235447 | 29845 | 313 | 313 | SNP | G | b73 | T | mo17 | | | | |
| 172 | Ampli-con235447 | 29846 | 321 | 321 | SNP | C | b73 | T | mo17 | | | | |
| 172 | Ampli-con235447 | 29847 | 329 | 329 | SNP | C | mo17 | T | b73 | | | | |
| 172 | Ampli-con235447 | 29848 | 441 | 441 | SNP | A | mo17 | T | b73 | | | | |
| 172 | Ampli-con235447 | 29849 | 488 | 488 | SNP | C | mo17 | T | b73 | | | | |
| 173 | Ampli-con235447 | 29867 | 80 | 83 | IND | **** | mo17 | TGAG | b73 | | | | |
| 173 | Ampli-con235455 | 29868 | 194 | 195 | IND | ** | mo17 | AA | b73 | | | | |
| 173 | Ampli-con235455 | 29869 | 362 | 362 | SNP | A | b73 | G | mo17 | | | | |
| 173 | Ampli-con235455 | 29870 | 364 | 364 | SNP | C | mo17 | G | b73 | | | | |
| 173 | Ampli-con235455 | 29871 | 374 | 374 | SNP | A | b73 | C | mo17 | | | | |
| 174 | Ampli-con235516 | 30000 | 152 | 152 | SNP | A | b73 | C | mo17 | | | | |
| 175 | Ampli-con235541 | 30025 | 170 | 170 | SNP | C | b73 | T | mo17 | | | | |
| 175 | Ampli-con235541 | 30026 | 196 | 196 | SNP | C | b73 | T | mo17 | | | | |
| 175 | Ampli-con235541 | 30027 | 265 | 265 | SNP | C | b73 | T | mo17 | | | | |
| 175 | Ampli-con235541 | 30028 | 283 | 283 | SNP | C | mo17 | G | b73 | | | | |
| 175 | Ampli-con235541 | 30029 | 316 | 316 | SNP | C | mo17 | T | b73 | | | | |
| 176 | Ampli-con235586 | 30174 | 674 | 674 | SNP | C | mo17 | T | b73 | | | | |
| 176 | Ampli-con235586 | 30175 | 699 | 699 | IND | * | b73 | C | mo17 | | | | |
| 176 | Ampli-con235586 | 30176 | 733 | 733 | SNP | A | mo17 | T | b73 | | | | |
| 177 | Ampli-con235641 | 30270 | 1134 | 1134 | SNP | C | mo17 | T | b73 | | | | |
| 178 | Ampli-con235855 | 30673 | 56 | 56 | SNP | C | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 178 | Ampli-con235855 | 30674 | 136 | 136 | SNP | C | mo17 | T | b73 | | | | |
| 178 | Ampli-con235855 | 30675 | 182 | 182 | SNP | A | b73 | G | mo17 | | | | |
| 178 | Ampli-con235855 | 30676 | 188 | 188 | SNP | C | mo17 | T | b73 | | | | |
| 178 | Ampli-con235855 | 30677 | 194 | 194 | SNP | C | b73 | T | mo17 | | | | |
| 178 | Ampli-con235855 | 30678 | 236 | 236 | SNP | A | b73 | C | mo17 | | | | |
| 178 | Ampli-con235855 | 30679 | 305 | 305 | SNP | C | b73 | T | mo17 | | | | |
| 178 | Ampli-con235855 | 30745 | 1028 | 1028 | SNP | C | mo17 | T | b73 | | | | |
| 179 | Ampli-con235879 | 30771 | 165 | 165 | SNP | C | mo17 | T | b73 | | | | |
| 180 | Ampli-con235892 | 30835 | 131 | 131 | SNP | A | mo17 | G | b73 | | | | |
| 181 | Ampli-con235914 | 30836 | 168 | 168 | SNP | G | b73 | T | mo17 | | | | |
| 181 | Ampli-con235914 | 30837 | 201 | 201 | SNP | A | mo17 | G | b73 | | | | |
| 181 | Ampli-con235914 | 30838 | 213 | 213 | SNP | C | b73 | T | mo17 | | | | |
| 181 | Ampli-con235914 | 30839 | 269 | 269 | SNP | A | mo17 | G | b73 | | | | |
| 181 | Ampli-con235914 | 30840 | 412 | 412 | SNP | A | b73 | G | mo17 | | | | |
| 182 | Ampli-con235959 | 30871 | 294 | 294 | SNP | A | b73 | G | mo17 | | | | |
| 182 | Ampli-con235959 | 30872 | 811 | 811 | SNP | C | b73 | T | b73 | | | | |
| 183 | Ampli-con236049 | 31050 | 33 | 33 | SNP | A | b73 | C | mo17 | | | | |
| 183 | Ampli-con236049 | 31051 | 35 | 35 | SNP | A | b73 | C | mo17 | | | | |
| 183 | Ampli-con236049 | 31052 | 37 | 37 | SNP | A | b73 | G | mo17 | | | | |
| 183 | Ampli-con236049 | 31053 | 46 | 46 | SNP | A | mo17 | T | b73 | | | | |
| 183 | Ampli-con236049 | 31054 | 47 | 47 | SNP | A | mo17 | G | b73 | | | | |
| 183 | Ampli-con236049 | 31055 | 48 | 48 | SNP | C | b73 | G | mo17 | | | | |
| 183 | Ampli-con236049 | 31056 | 51 | 51 | SNP | A | b73 | T | mo17 | | | | |
| 183 | Ampli-con236049 | 31057 | 53 | 53 | SNP | C | b73 | T | mo17 | | | | |
| 183 | Ampli-con236049 | 31058 | 54 | 54 | SNP | A | b73 | C | mo17 | | | | |
| 183 | Ampli-con236049 | 31059 | 55 | 55 | SNP | A | b73 | C | mo17 | | | | |
| 183 | Ampli-con236049 | 31060 | 56 | 56 | SNP | G | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 183 | Ampli-con236049 | 31061 | 58 | 58 | SNP | C | b73 | G | mo17 | | | | |
| 183 | Ampli-con236049 | 31062 | 62 | 62 | SNP | C | b73 | T | mo17 | | | | |
| 183 | Ampli-con236049 | 31063 | 64 | 65 | IND | ** | mo17 | TC | b73 | | | | |
| 183 | Ampli-con236049 | 31064 | 125 | 125 | SNP | A | b73 | C | mo17 | | | | |
| 183 | Ampli-con236049 | 31065 | 179 | 179 | SNP | C | mo17 | G | b73 | | | | |
| 183 | Ampli-con236049 | 31066 | 539 | 539 | SNP | G | mo17 | T | b73 | | | | |
| 184 | Ampli-con236057 | 31084 | 52 | 52 | SNP | C | b73 | G | mo17 | | | | |
| 184 | Ampli-con236057 | 31085 | 297 | 297 | SNP | A | mo17 | G | b73 | | | | |
| 185 | Ampli-con236120 | 31233 | 1066 | 1066 | SNP | A | mo17 | C | b73 | | | | |
| 186 | Ampli-con236181 | 31370 | 432 | 432 | SNP | G | mo17 | T | b73 | | | | |
| 187 | Ampli-con236216 | 31473 | 760 | 760 | SNP | A | b73 | G | mo17 | | | | |
| 187 | Ampli-con236216 | 31474 | 843 | 843 | SNP | A | mo17 | T | b73 | | | | |
| 187 | Ampli-con236216 | 31475 | 938 | 938 | SNP | C | mo17 | G | b73 | | | | |
| 187 | Ampli-con236216 | 31476 | 1016 | 1016 | IND | * | mo17 | T | b73 | | | | |
| 188 | Ampli-con236259 | 31477 | 1058 | 1058 | SNP | A | mo17 | G | b73 | | | | |
| 188 | Ampli-con236259 | 31546 | 306 | 306 | SNP | A | mo17 | C | b73 | | | | |
| 188 | Ampli-con236259 | 31547 | 473 | 473 | SNP | C | mo17 | T | b73 | | | | |
| 188 | Ampli-con236259 | 31548 | 482 | 482 | SNP | A | b73 | G | mo17 | | | | |
| 189 | Ampli-con236326 | 31684 | 259 | 259 | SNP | A | b73 | T | b73 | | | | |
| 190 | Ampli-con236386 | 31790 | 510 | 510 | SNP | A | mo17 | T | b73 | | | | |
| 191 | Ampli-con236471 | 31993 | 365 | 365 | SNP | A | mo17 | G | b73 | | | | |
| 191 | Ampli-con236471 | 31994 | 367 | 367 | IND | * | mo17 | C | b73 | | | | |
| 192 | Ampli-con236482 | 32014 | 68 | 68 | SNP | A | mo17 | G | mo17 | | | | |
| 192 | Ampli-con236482 | 32015 | 93 | 93 | SNP | C | b73 | G | b73 | | | | |
| 192 | Ampli-con236482 | 32016 | 196 | 196 | SNP | A | b73 | G | mo17 | | | | |
| 192 | Ampli-con236482 | 32017 | 674 | 674 | SNP | G | b73 | T | mo17 | | | | |
| 193 | Ampli-con236492 | 32028 | 81 | 81 | SNP | C | mo17 | T | b73 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 193 | Ampli-con236492 | 32029 | 102 | 102 | SNP | C | mo17 | G | b73 | | | | |
| 193 | Ampli-con236492 | 32030 | 162 | 164 | IND | *** | b73 | TGG | mo17 | | | | |
| 193 | Ampli-con236492 | 32031 | 192 | 197 | IND | ****** | b73 | TGCCGG | mo17 | | | | |
| 193 | Ampli-con236492 | 32032 | 310 | 310 | SNP | A | mo17 | C | b73 | | | | |
| 193 | Ampli-con236492 | 32033 | 435 | 435 | SNP | C | b73 | T | mo17 | | | | |
| 194 | Ampli-con236492 | 32034 | 497 | 497 | SNP | A | mo17 | G | b73 | | | | |
| 195 | Ampli-con236499 | 32049 | 182 | 182 | SNP | C | mo17 | T | b73 | | | | |
| 195 | Ampli-con236499 | 32050 | 401 | 401 | SNP | C | b73 | T | mo17 | | | | |
| 195 | Ampli-con236499 | 32051 | 402 | 402 | SNP | A | b73 | G | mo17 | | | | |
| 196 | Ampli-con236499 | 32137 | 257 | 257 | IND | * | b73 | A | mo17 | | | | |
| 196 | Ampli-con236541 | 32138 | 419 | 429 | IND | *********** | mo17 | CCGATCCATCT | b73 | | | | |
| 197 | Ampli-con236541 | 32244 | 26 | 26 | SNP | C | b73 | T | mo17 | | | | |
| 197 | Ampli-con236590 | 32245 | 81 | 81 | SNP | A | b73 | G | mo17 | | | | |
| 197 | Ampli-con236590 | 32246 | 91 | 97 | IND | ******* | mo17 | AGTGCTG | b73 | | | | |
| 197 | Ampli-con236590 | 32247 | 161 | 161 | SNP | C | b73 | T | mo17 | | | | |
| 198 | Ampli-con236590 | 32248 | 274 | 274 | SNP | C | b73 | T | mo17 | | | | |
| 198 | Ampli-con236597 | 32252 | 36 | 36 | SNP | C | b73 | G | mo17 | | | | |
| 198 | Ampli-con236597 | 32253 | 43 | 43 | SNP | A | mo17 | C | b73 | | | | |
| 198 | Ampli-con236597 | 32254 | 117 | 117 | SNP | C | mo17 | T | b73 | | | | |
| 198 | Ampli-con236597 | 32255 | 288 | 288 | SNP | C | mo17 | G | b73 | | | | |
| 198 | Ampli-con236597 | 32256 | 318 | 318 | SNP | A | mo17 | G | b73 | | | | |
| 198 | Ampli-con236597 | 32257 | 345 | 345 | SNP | A | b73 | G | mo17 | | | | |
| 198 | Ampli-con236597 | 32258 | 351 | 351 | SNP | G | b73 | T | mo17 | | | | |
| 198 | Ampli-con236597 | 32259 | 364 | 364 | SNP | C | mo17 | T | b73 | | | | |
| 198 | Ampli-con236597 | 32260 | 407 | 407 | SNP | C | mo17 | G | b73 | | | | |
| 198 | Ampli-con236597 | 32261 | 450 | 450 | SNP | C | b73 | T | mo17 | | | | |
| 198 | Ampli-con236597 | 32262 | 458 | 458 | SNP | A | mo17 | G | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 198 | Ampli-con236597 | 32263 | 582 | 582 | SNP | A | b73 | G | mo17 | | | | |
| 198 | Ampli-con236597 | 32264 | 589 | 589 | SNP | A | b73 | G | mo17 | | | | |
| 198 | Ampli-con236597 | 32265 | 604 | 604 | SNP | C | mo17 | T | b73 | | | | |
| 198 | Ampli-con236597 | 32266 | 848 | 848 | SNP | A | b73 | G | mo17 | | | | |
| 198 | Ampli-con236597 | 32267 | 865 | 865 | SNP | C | mo17 | T | b73 | | | | |
| 199 | Ampli-con236600 | 32272 | 260 | 260 | SNP | C | mo17 | T | b73 | | | | |
| 200 | Ampli-con236692 | 32428 | 101 | 101 | SNP | C | mo17 | G | b73 | | | | |
| 200 | Ampli-con236692 | 32429 | 112 | 112 | SNP | A | b73 | G | mo17 | | | | |
| 200 | Ampli-con236692 | 32430 | 202 | 202 | SNP | A | b73 | G | mo17 | | | | |
| 200 | Ampli-con236692 | 32431 | 250 | 250 | SNP | C | mo17 | T | b73 | | | | |
| 201 | Ampli-con276424 | 33246 | 113 | 113 | SNP | G | mo17 | T | b73 | | | | |
| 201 | Ampli-con276424 | 33247 | 120 | 120 | SNP | A | mo17 | G | b73 | | | | |
| 201 | Ampli-con276424 | 33248 | 140 | 140 | SNP | A | b73 | G | mo17 | | | | |
| 201 | Ampli-con276424 | 33249 | 190 | 190 | SNP | C | mo17 | T | b73 | | | | |
| 201 | Ampli-con276424 | 33250 | 231 | 231 | IND | * | b73 | A | mo17 | | | | |
| 201 | Ampli-con276424 | 33251 | 231 | 232 | IND | ** | b73 | AT | mo17 | | | | |
| 201 | Ampli-con276424 | 33252 | 243 | 243 | SNP | G | b73 | T | mo17 | | | | |
| 201 | Ampli-con276424 | 33253 | 296 | 296 | SNP | G | b73 | T | mo17 | | | | |
| 201 | Ampli-con276424 | 33254 | 340 | 340 | IND | * | b73 | G | mo17 | | | | |
| 201 | Ampli-con276424 | 33255 | 341 | 342 | IND | ** | b73 | CC | mo17 | | | | |
| 202 | Ampli-con276456 | 33315 | 93 | 93 | SNP | A | b73 | G | mo17 | | | | |
| 202 | Ampli-con276456 | 33316 | 111 | 111 | SNP | C | b73 | T | mo17 | | | | |
| 202 | Ampli-con276456 | 33317 | 118 | 118 | SNP | A | b73 | T | mo17 | | | | |
| 202 | Ampli-con276456 | 33318 | 151 | 153 | IND | *** | mo17 | TGT | b73 | | | | |
| 202 | Ampli-con276456 | 33319 | 154 | 157 | IND | **** | mo17 | TCTG | b73 | | | | |
| 202 | Ampli-con276456 | 33320 | 208 | 208 | SNP | C | b73 | G | mo17 | | | | |
| 202 | Ampli-con276456 | 33321 | 241 | 241 | SNP | A | mo17 | G | b73 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 202 | Ampli-con276456 | 33322 | 396 | 396 | SNP | C | b73 | T | mo17 | | | | |
| 203 | Ampli-con276493 | 33371 | 163 | 163 | IND | * | mo17 | G | b73 | | | | |
| 203 | Ampli-con276493 | 33372 | 238 | 238 | SNP | A | b73 | C | mo17 | | | | |
| 204 | Ampli-con276497 | 33373 | 95 | 95 | SNP | C | mo17 | T | b73 | | | | |
| 204 | Ampli-con276497 | 33374 | 127 | 127 | SNP | C | mo17 | T | b73 | | | | |
| 204 | Ampli-con276497 | 33375 | 130 | 130 | SNP | C | b73 | T | mo17 | | | | |
| 204 | Ampli-con276497 | 33376 | 362 | 362 | SNP | G | b73 | T | mo17 | | | | |
| 204 | Ampli-con276497 | 33377 | 370 | 370 | SNP | A | mo17 | G | b73 | | | | |
| 205 | Ampli-con276744 | 33764 | 728 | 728 | SNP | C | b73 | T | mo17 | | | | |
| 205 | Ampli-con276744 | 33765 | 835 | 835 | SNP | A | mo17 | T | b73 | | | | |
| 205 | Ampli-con276744 | 33766 | 874 | 874 | SNP | C | b73 | T | mo17 | | | | |
| 205 | Ampli-con276744 | 33767 | 919 | 919 | SNP | A | mo17 | T | b73 | | | | |
| 205 | Ampli-con276744 | 33768 | 1014 | 1014 | SNP | A | b73 | T | mo17 | | | | |
| 205 | Ampli-con276744 | 33769 | 1078 | 1081 | IND | **** | mo17 | TAGC | b73 | | | | |
| 206 | Ampli-con276782 | 33816 | 252 | 252 | SNP | C | mo17 | T | b73 | | | | |
| 206 | Ampli-con276782 | 33819 | 319 | 319 | SNP | A | mo17 | G | b73 | | | | |
| 207 | Ampli-con277037 | 34205 | 117 | 117 | SNP | C | mo17 | T | b73 | | | | |
| 207 | Ampli-con277037 | 34206 | 248 | 248 | SNP | A | b73 | T | mo17 | | | | |
| 208 | Ampli-con277306 | 34556 | 519 | 519 | SNP | A | b73 | G | mo17 | | | | |
| 208 | Ampli-con277306 | 34557 | 558 | 558 | SNP | A | mo17 | G | b73 | | | | |
| 208 | Ampli-con277306 | 34558 | 576 | 576 | SNP | A | b73 | G | mo17 | | | | |
| 208 | Ampli-con277306 | 34559 | 625 | 625 | SNP | C | mo17 | T | b73 | | | | |
| 208 | Ampli-con277306 | 34560 | 681 | 681 | SNP | A | b73 | G | mo17 | | | | |
| 208 | Ampli-con277306 | 34561 | 770 | 770 | SNP | C | mo17 | T | b73 | | | | |
| 208 | Ampli-con277306 | 34562 | 771 | 771 | IND | * | b73 | A | mo17 | | | | |
| 208 | Ampli-con277306 | 34563 | 788 | 788 | SNP | C | b73 | T | mo17 | | | | |
| 208 | Ampli-con277306 | 34564 | 852 | 852 | SNP | A | b73 | G | mo17 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 209 | Amplicon277511 | 34895 | 47 | 47 | SNP | C | b73 | G | mo17 | | | | |
| 209 | Amplicon277511 | 34896 | 48 | 48 | SNP | C | b73 | T | mo17 | | | | |
| 209 | Amplicon277511 | 34897 | 52 | 52 | IND | * | b73 | C | mo17 | | | | |
| 209 | Amplicon277511 | 34898 | 52 | 53 | IND | ** | b73 | C* | mo17 | | | | |
| 209 | Amplicon277511 | 34899 | 75 | 75 | SNP | C | b73 | T | mo17 | | | | |
| 209 | Amplicon277511 | 34900 | 307 | 307 | SNP | A | mo17 | C | b73 | | | | |
| 209 | Amplicon277511 | 34901 | 344 | 344 | SNP | A | mo17 | G | b73 | | | | |
| 209 | Amplicon277511 | 34902 | 347 | 347 | SNP | C | b73 | T | mo17 | | | | |
| 209 | Amplicon277511 | 34903 | 408 | 408 | SNP | C | mo17 | T | b73 | | | | |
| 209 | Amplicon277511 | 35173 | 659 | 659 | IND | * | mo17 | G | b73 | | | | |
| 210 | Amplicon277716 | 35174 | 767 | 767 | SNP | C | b73 | T | mo17 | | | | |
| 210 | Amplicon277716 | 35175 | 770 | 770 | SNP | A | mo17 | G | b73 | | | | |
| 211 | Amplicon277824 | 35294 | 186 | 186 | SNP | A | mo17 | G | mo17 | | | | |
| 212 | Amplicon277832 | 35295 | 102 | 102 | SNP | C | b73 | T | mo17 | | | | |
| 212 | Amplicon277832 | 35296 | 193 | 193 | SNP | A | mo17 | G | b73 | | | | |
| 212 | Amplicon277832 | 35297 | 206 | 206 | SNP | A | b73 | G | mo17 | | | | |
| 212 | Amplicon277832 | 35298 | 218 | 218 | IND | * | b73 | C | mo17 | | | | |
| 212 | Amplicon277832 | 35299 | 220 | 222 | IND | *** | b73 | GCT | mo17 | | | | |
| 212 | Amplicon277832 | 35300 | 265 | 265 | SNP | C | mo17 | T | b73 | | | | |
| 212 | Amplicon277832 | 35301 | 277 | 279 | IND | *** | mo17 | ATG | b73 | | | | |
| 212 | Amplicon277832 | 35302 | 449 | 449 | SNP | C | b73 | T | mo17 | | | | |
| 213 | Amplicon277876 | 35338 | 104 | 104 | SNP | C | mo17 | G | b73 | | | | |
| 213 | Amplicon277876 | 35339 | 329 | 333 | IND | ***** | b73 | CAAAG | mo17 | | | | |
| 213 | Amplicon277876 | 35340 | 367 | 367 | SNP | A | b73 | G | mo17 | | | | |
| 214 | Amplicon277914 | 35377 | 66 | 66 | SNP | C | b73 | G | mo17 | | | | |
| 215 | Amplicon277962 | 35407 | 31 | 31 | SNP | A | mo17 | G | b73 | | | | |
| 215 | Amplicon277962 | 35408 | 220 | 220 | SNP | A | mo17 | C | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 215 | Amplicon277962 | 35409 | 292 | 292 | SNP | A | b73 | C | mo17 | | | | |
| 215 | Amplicon277962 | 35410 | 339 | 339 | SNP | A | mo17 | G | b73 | | | | |
| 216 | Amplicon277971 | 35413 | 48 | 48 | SNP | A | b73 | C | mo17 | | | | |
| 216 | Amplicon277971 | 35414 | 58 | 58 | SNP | A | mo17 | G | b73 | | | | |
| 216 | Amplicon277971 | 35415 | 160 | 161 | IND | ** | mo17 | TA | b73 | | | | |
| 216 | Amplicon277971 | 35416 | 163 | 163 | SNP | G | b73 | T | mo17 | | | | |
| 216 | Amplicon277971 | 35417 | 175 | 175 | SNP | A | b73 | G | mo17 | | | | |
| 216 | Amplicon277971 | 35418 | 254 | 254 | IND | * | mo17 | T | b73 | | | | |
| 217 | Amplicon278078 | 35567 | 278 | 278 | SNP | G | b73 | T | mo17 | | | | |
| 217 | Amplicon278078 | 35568 | 297 | 297 | SNP | A | mo17 | G | b73 | | | | |
| 217 | Amplicon278078 | 35569 | 331 | 331 | IND | * | b73 | G | mo17 | | | | |
| 218 | Amplicon278078 | 35574 | 384 | 384 | SNP | C | mo17 | T | b73 | | | | |
| 219 | Amplicon278086 | 35631 | 115 | 115 | SNP | C | mo17 | T | b73 | | | | |
| 219 | Amplicon278122 | 35632 | 267 | 267 | SNP | A | b73 | G | mo17 | | | | |
| 219 | Amplicon278122 | 35633 | 318 | 318 | SNP | A | b73 | C | mo17 | | | | |
| 220 | Amplicon278122 | 36022 | 77 | 77 | SNP | C | b73 | G | mo17 | | | | |
| 220 | Amplicon310557 | 36023 | 80 | 80 | SNP | G | b73 | T | mo17 | | | | |
| 220 | Amplicon310557 | 36024 | 269 | 269 | SNP | A | mo17 | G | b73 | | | | |
| 220 | Amplicon310557 | 36025 | 283 | 283 | SNP | G | mo17 | T | b73 | | | | |
| 220 | Amplicon310557 | 36026 | 353 | 353 | IND | * | mo17 | A | b73 | | | | |
| 220 | Amplicon310557 | 36027 | 353 | 354 | IND | ** | mo17 | AT | b73 | | | | |
| 221 | Amplicon310599 | 36062 | 94 | 94 | SNP | A | mo17 | C | b73 | | | | |
| 221 | Amplicon310599 | 36063 | 95 | 95 | SNP | A | mo17 | C | b73 | | | | |
| 221 | Amplicon310599 | 36064 | 128 | 128 | SNP | C | mo17 | G | b73 | | | | |
| 221 | Amplicon310599 | 36065 | 129 | 129 | SNP | A | mo17 | G | b73 | | | | |
| 221 | Amplicon310599 | 36066 | 135 | 135 | SNP | G | mo17 | T | b73 | | | | |
| 221 | Amplicon310599 | 36067 | 144 | 144 | SNP | C | b73 | T | mo17 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 221 | Ampli-con310599 | 36068 | 279 | 279 | SNP | G | b73 | T | mo17 | | | | |
| 221 | Ampli-con310599 | 36069 | 280 | 280 | SNP | C | mo17 | T | b73 | | | | |
| 221 | Ampli-con310599 | 36070 | 300 | 300 | IND | * | b73 | A | mo17 | | | | |
| 221 | Ampli-con310599 | 36071 | 324 | 324 | SNP | A | b73 | T | mo17 | | | | |
| 221 | Ampli-con310599 | 36072 | 367 | 367 | SNP | A | mo17 | G | b73 | | | | |
| 221 | Ampli-con310599 | 36073 | 403 | 403 | SNP | A | mo17 | G | b73 | | | | |
| 221 | Ampli-con310599 | 36074 | 422 | 422 | SNP | C | mo17 | T | b73 | | | | |
| 221 | Ampli-con310599 | 36075 | 426 | 426 | SNP | C | mo17 | T | b73 | | | | |
| 221 | Ampli-con310599 | 36076 | 465 | 465 | SNP | C | mo17 | T | b73 | | | | |
| 222 | Ampli-con310656 | 36195 | 119 | 119 | SNP | A | mo17 | C | b73 | | | | |
| 222 | Ampli-con310656 | 36196 | 122 | 122 | SNP | C | b73 | T | mo17 | | | | |
| 222 | Ampli-con310656 | 36197 | 134 | 134 | SNP | A | b73 | C | mo17 | | | | |
| 222 | Ampli-con310656 | 36198 | 146 | 146 | SNP | A | mo17 | C | b73 | | | | |
| 222 | Ampli-con310656 | 36199 | 182 | 182 | SNP | A | mo17 | C | b73 | | | | |
| 222 | Ampli-con310656 | 36200 | 213 | 218 | IND | ******* | mo17 | AGCGAC | b73 | | | | |
| 222 | Ampli-con310656 | 36201 | 239 | 239 | SNP | A | b73 | G | mo17 | | | | |
| 222 | Ampli-con310656 | 36202 | 317 | 317 | SNP | C | b73 | G | mo17 | | | | |
| 223 | Ampli-con310739 | 36286 | 335 | 336 | IND | ** | mo17 | AT | b73 | | | | |
| 223 | Ampli-con310739 | 36287 | 435 | 436 | IND | ** | b73 | CT | mo17 | | | | |
| 223 | Ampli-con310739 | 36288 | 455 | 455 | SNP | A | b73 | G | mo17 | | | | |
| 224 | Ampli-con310739 | 36323 | 240 | 240 | SNP | G | mo17 | T | b73 | | | | |
| 225 | Ampli-con310755 | 36448 | 201 | 201 | SNP | C | mo17 | T | b73 | | | | |
| 225 | Ampli-con310817 | 36449 | 252 | 254 | IND | *** | mo17 | AGC | b73 | | | | |
| 226 | Ampli-con310817 | 36487 | 201 | 203 | IND | *** | b73 | TGG | mo17 | | | | |
| 226 | Ampli-con310854 | 36488 | 227 | 228 | IND | ** | b73 | AT | mo17 | | | | |
| 226 | Ampli-con310854 | 36489 | 235 | 235 | IND | * | mo17 | T | b73 | | | | |
| 226 | Ampli-con310854 | 36490 | 243 | 243 | SNP | G | b73 | T | mo17 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 226 | Amplicon310854 | 36491 | 272 | 274 | IND | *** | b73 | TAG | mo17 | | | | |
| 226 | Amplicon310854 | 36492 | 272 | 275 | IND | **** | b73 | TAGC | mo17 | | | | |
| 226 | Amplicon310854 | 36493 | 315 | 316 | IND | ** | mo17 | GA | b73 | | | | |
| 226 | Amplicon310854 | 36494 | 319 | 319 | SNP | C | b73 | T | mo17 | | | | |
| 227 | Amplicon311004 | 36636 | 637 | 637 | SNP | A | mo17 | G | b73 | | | | |
| 227 | Amplicon311004 | 36637 | 698 | 698 | SNP | C | mo17 | T | b73 | | | | |
| 227 | Amplicon311004 | 36638 | 957 | 957 | SNP | G | mo17 | T | b73 | | | | |
| 227 | Amplicon311004 | 36639 | 958 | 958 | SNP | G | b73 | G | mo17 | | | | |
| 227 | Amplicon311004 | 36640 | 968 | 968 | SNP | A | mo17 | C | b73 | | | | |
| 227 | Amplicon311004 | 36641 | 1085 | 1085 | SNP | A | mo17 | G | b73 | | | | |
| 227 | Amplicon311004 | 36642 | 1086 | 1086 | SNP | A | b73 | G | mo17 | | | | |
| 227 | Amplicon311004 | 36643 | 1127 | 1127 | SNP | A | b73 | G | mo17 | | | | |
| 228 | Amplicon311038 | 36685 | 202 | 202 | SNP | A | mo17 | T | b73 | | | | |
| 228 | Amplicon311038 | 36686 | 444 | 444 | SNP | A | mo17 | T | b73 | | | | |
| 229 | Amplicon311045 | 36694 | 179 | 179 | SNP | C | b73 | T | mo17 | | | | |
| 229 | Amplicon311045 | 36695 | 242 | 242 | SNP | C | b73 | T | mo17 | | | | |
| 230 | Amplicon311184 | 36862 | 296 | 296 | SNP | A | mo17 | G | b73 | | | | |
| 230 | Amplicon311184 | 36863 | 326 | 326 | SNP | C | b73 | T | mo17 | | | | |
| 230 | Amplicon311184 | 36864 | 374 | 374 | SNP | C | b73 | T | mo17 | | | | |
| 230 | Amplicon311184 | 36865 | 507 | 507 | SNP | A | mo17 | C | b73 | | | | |
| 230 | Amplicon311184 | 36866 | 547 | 547 | SNP | C | b73 | T | mo17 | | | | |
| 231 | Amplicon311375 | 37066 | 105 | 105 | SNP | C | b73 | T | mo17 | | | | |
| 231 | Amplicon311375 | 37067 | 127 | 127 | SNP | A | b73 | G | mo17 | | | | |
| 231 | Amplicon311375 | 37068 | 163 | 171 | IND | ********* | mo17 | GATACGGCG | b73 | | | | |
| 232 | Amplicon311650 | 37492 | 125 | 125 | IND | * | mo17 | G | b73 | | | | |
| 232 | Amplicon311650 | 37493 | 130 | 130 | SNP | A | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 232 | Ampli-con311650 | 37494 | 204 | 204 | SNP | A | mo17 | G | b73 | | | | |
| 232 | Ampli-con311650 | 37495 | 211 | 211 | SNP | A | b73 | G | mo17 | | | | |
| 232 | Ampli-con311650 | 37496 | 212 | 212 | SNP | A | b73 | G | mo17 | | | | |
| 232 | Ampli-con311650 | 37497 | 221 | 221 | IND | * | mo17 | G | b73 | | | | |
| 232 | Ampli-con311650 | 37498 | 236 | 236 | SNP | G | mo17 | T | b73 | | | | |
| 232 | Ampli-con311650 | 37499 | 239 | 242 | IND | **** | mo17 | CTTG | b73 | | | | |
| 232 | Ampli-con311650 | 37500 | 359 | 362 | IND | **** | mo17 | TGCC | b73 | | | | |
| 232 | Ampli-con311650 | 37501 | 410 | 410 | SNP | A | mo17 | C | b73 | | | | |
| 232 | Ampli-con311650 | 37502 | 411 | 411 | SNP | A | b73 | C | mo17 | | | | |
| 232 | Ampli-con311650 | 37503 | 426 | 426 | SNP | G | mo17 | T | b73 | | | | |
| 232 | Ampli-con311650 | 37504 | 465 | 471 | IND | ******* | mo17 | AGTGCTG | b73 | | | | |
| 232 | Ampli-con311650 | 37505 | 535 | 536 | IND | ** | mo17 | CT | b73 | | | | |
| 232 | Ampli-con311650 | 37506 | 541 | 541 | SNP | C | b73 | T | mo17 | | | | |
| 232 | Ampli-con311650 | 37507 | 610 | 610 | IND | * | mo17 | C | b73 | | | | |
| 233 | Ampli-con311695 | 37555 | 394 | 394 | SNP | C | b73 | T | mo17 | | | | |
| 233 | Ampli-con311695 | 37556 | 505 | 505 | SNP | A | mo17 | G | b73 | | | | |
| 234 | Ampli-con311695 | 37631 | 271 | 271 | SNP | C | mo17 | G | b73 | | | | |
| 234 | Ampli-con311738 | 37632 | 333 | 340 | IND | ********* | mo17 | CGTTCTAA | b73 | | | | |
| 234 | Ampli-con311738 | 37633 | 389 | 397 | IND | ********** | b73 | CGTTGGGGG | mo17 | | | | |
| 234 | Ampli-con311738 | 37634 | 542 | 542 | SNP | G | mo17 | T | b73 | | | | |
| 235 | Ampli-con311738 | 37684 | 397 | 397 | SNP | C | b73 | T | mo17 | | | | |
| 235 | Ampli-con346446 | 37685 | 407 | 407 | SNP | A | mo17 | C | b73 | | | | |
| 235 | Ampli-con346446 | 37686 | 417 | 417 | SNP | A | mo17 | T | b73 | | | | |
| 235 | Ampli-con346446 | 37687 | 483 | 483 | IND | * | b73 | G | mo17 | | | | |
| 235 | Ampli-con346446 | 37688 | 562 | 562 | SNP | C | mo17 | T | b73 | | | | |
| 235 | Ampli-con346446 | 37689 | 685 | 691 | IND | ******** | mo17 | ATTATAA | b73 | | | | |
| 236 | Ampli-con346472 | 37715 | 392 | 392 | SNP | A | b73 | G | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 236 | Amplicon346472 | 37716 | 512 | 512 | SNP | C | b73 | T | mo17 | | | | |
| 236 | Amplicon346472 | 37717 | 522 | 522 | IND | * | mo17 | A | b73 | | | | |
| 236 | Amplicon346472 | 37718 | 563 | 563 | SNP | G | mo17 | T | b73 | | | | |
| 236 | Amplicon346472 | 37719 | 573 | 576 | IND | **** | b73 | ACGA | mo17 | | | | |
| 237 | Amplicon346640 | 37946 | 41 | 41 | SNP | A | mo17 | G | b73 | | | | |
| 237 | Amplicon346640 | 37947 | 86 | 86 | SNP | A | b73 | G | mo17 | | | | |
| 237 | Amplicon346640 | 37948 | 134 | 134 | SNP | G | b73 | T | mo17 | | | | |
| 237 | Amplicon346640 | 37949 | 191 | 191 | SNP | A | mo17 | G | b73 | | | | |
| 237 | Amplicon346640 | 37950 | 194 | 194 | SNP | C | b73 | T | mo17 | | | | |
| 237 | Amplicon346640 | 37951 | 197 | 197 | SNP | C | b73 | T | mo17 | | | | |
| 237 | Amplicon346640 | 37952 | 199 | 199 | SNP | A | mo17 | G | b73 | | | | |
| 237 | Amplicon346640 | 37953 | 229 | 232 | IND | **** | mo17 | TATA | b73 | | | | |
| 237 | Amplicon346640 | 37954 | 284 | 284 | IND | * | b73 | C | mo17 | | | | |
| 237 | Amplicon346640 | 37955 | 286 | 286 | IND | * | b73 | A | mo17 | | | | |
| 237 | Amplicon346640 | 37956 | 288 | 288 | SNP | A | b73 | C | mo17 | | | | |
| 237 | Amplicon346640 | 37957 | 343 | 343 | SNP | A | mo17 | G | b73 | | | | |
| 237 | Amplicon346640 | 37958 | 368 | 368 | IND | * | mo17 | C | b73 | | | | |
| 237 | Amplicon346640 | 37959 | 392 | 392 | SNP | G | mo17 | T | b73 | | | | |
| 237 | Amplicon346640 | 37960 | 393 | 394 | IND | ** | mo17 | TT | b73 | | | | |
| 237 | Amplicon346640 | 37961 | 397 | 397 | SNP | A | b73 | G | mo17 | | | | |
| 237 | Amplicon346640 | 37962 | 410 | 410 | SNP | A | mo17 | C | b73 | | | | |
| 237 | Amplicon346640 | 37963 | 411 | 411 | SNP | A | mo17 | G | b73 | | | | |
| 237 | Amplicon346640 | 37964 | 450 | 450 | SNP | G | mo17 | T | b73 | | | | |
| 237 | Amplicon346640 | 37965 | 514 | 514 | SNP | A | mo17 | G | b73 | | | | |
| 237 | Amplicon346640 | 37966 | 552 | 552 | SNP | C | b73 | G | mo17 | | | | |
| 237 | Amplicon346640 | 37967 | 773 | 773 | SNP | A | mo17 | C | b73 | | | | |
| 238 | Amplicon346980 | 38478 | 262 | 262 | SNP | C | mo17 | T | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 238 | Ampli-con346980 | 38479 | 400 | 400 | SNP | A | b73 | C | mo17 | | | | |
| 238 | Ampli-con346980 | 38480 | 549 | 554 | IND | ****** | b73 | TCGCTC | mo17 | | | | |
| 239 | Ampli-con347076 | 38604 | 172 | 172 | SNP | A | mo17 | G | b73 | | | | |
| 239 | Ampli-con347076 | 38605 | 207 | 207 | SNP | C | mo17 | T | b73 | | | | |
| 239 | Ampli-con347076 | 38606 | 224 | 224 | SNP | A | mo17 | A | b73 | | | | |
| 239 | Ampli-con347076 | 38607 | 252 | 253 | IND | ** | b73 | GG | mo17 | | | | |
| 239 | Ampli-con347076 | 38608 | 380 | 380 | SNP | A | mo17 | G | b73 | | | | |
| 239 | Ampli-con347076 | 38609 | 387 | 387 | SNP | A | b73 | G | mo17 | | | | |
| 239 | Ampli-con347076 | 38610 | 432 | 432 | SNP | G | b73 | T | mo17 | | | | |
| 239 | Ampli-con347076 | 38611 | 505 | 505 | SNP | A | mo17 | G | b73 | | | | |
| 239 | Ampli-con347076 | 38612 | 506 | 506 | SNP | A | mo17 | G | b73 | | | | |
| 239 | Ampli-con347076 | 38613 | 515 | 515 | IND | * | b73 | T | mo17 | | | | |
| 239 | Ampli-con347076 | 38614 | 521 | 521 | IND | * | b73 | T | mo17 | | | | |
| 239 | Ampli-con347076 | 38615 | 587 | 592 | IND | ****** | b73 | CCCCCA | mo17 | | | | |
| 239 | Ampli-con347076 | 38616 | 599 | 599 | SNP | A | mo17 | G | b73 | | | | |
| 239 | Ampli-con347076 | 38617 | 611 | 611 | SNP | A | mo17 | G | b73 | | | | |
| 239 | Ampli-con347076 | 38618 | 614 | 614 | SNP | G | b73 | T | mo17 | | | | |
| 240 | Ampli-con347095 | 38652 | 23 | 23 | IND | * | b73 | A | mo17 | | | | |
| 240 | Ampli-con347095 | 38653 | 200 | 200 | SNP | A | mo17 | T | b73 | | | | |
| 240 | Ampli-con347095 | 38654 | 414 | 414 | SNP | A | mo17 | G | b73 | | | | |
| 240 | Ampli-con347095 | 38655 | 599 | 599 | SNP | C | mo17 | T | b73 | | | | |
| 240 | Ampli-con347095 | 38656 | 682 | 682 | SNP | A | b73 | T | mo17 | | | | |
| 241 | Ampli-con347114 | 38700 | 228 | 228 | SNP | C | b73 | T | mo17 | | | | |
| 241 | Ampli-con347114 | 38701 | 303 | 308 | IND | ****** | b73 | AATCAT | mo17 | | | | |
| 242 | Ampli-con347251 | 38848 | 39 | 39 | SNP | G | b73 | T | mo17 | | | | |
| 242 | Ampli-con347251 | 38849 | 83 | 83 | SNP | A | mo17 | T | b73 | | | | |
| 242 | Ampli-con347251 | 38850 | 262 | 262 | SNP | G | b73 | T | mo17 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 242 | Ampli-con347251 | 38851 | 263 | 264 | IND | ** | b73 | TT | mo17 | | | | |
| 242 | Ampli-con347251 | 38852 | 550 | 550 | SNP | C | b73 | G | mo17 | | | | |
| 243 | Ampli-con347285 | 38909 | 41 | 41 | SNP | A | b73 | T | mo17 | | | | |
| 243 | Ampli-con347285 | 38910 | 93 | 96 | IND | **** | mo17 | TGCA | b73 | | | | |
| 243 | Ampli-con347285 | 38911 | 99 | 99 | SNP | A | b73 | G | mo17 | | | | |
| 243 | Ampli-con347285 | 38912 | 100 | 100 | SNP | C | b73 | T | mo17 | | | | |
| 243 | Ampli-con347285 | 38913 | 105 | 105 | SNP | A | mo17 | C | b73 | | | | |
| 243 | Ampli-con347285 | 38914 | 128 | 131 | IND | **** | mo17 | ATTA | b73 | | | | |
| 243 | Ampli-con347285 | 38915 | 148 | 148 | SNP | A | mo17 | G | b73 | | | | |
| 243 | Ampli-con347285 | 38916 | 152 | 152 | SNP | A | mo17 | C | b73 | | | | |
| 243 | Ampli-con347285 | 38917 | 158 | 158 | SNP | C | b73 | T | mo17 | | | | |
| 243 | Ampli-con347285 | 38918 | 175 | 175 | SNP | A | mo17 | G | b73 | | | | |
| 243 | Ampli-con347285 | 38919 | 180 | 180 | IND | * | mo17 | G | b73 | | | | |
| 243 | Ampli-con347285 | 38920 | 280 | 280 | SNP | C | b73 | T | mo17 | | | | |
| 243 | Ampli-con347285 | 38921 | 375 | 375 | SNP | C | mo17 | G | b73 | | | | |
| 243 | Ampli-con347285 | 38922 | 511 | 511 | SNP | G | mo17 | T | b73 | | | | |
| 243 | Ampli-con347285 | 38923 | 517 | 517 | SNP | C | mo17 | T | b73 | | | | |
| 244 | Ampli-con347285 | 39063 | 80 | 80 | SNP | A | mo17 | G | b73 | | | | |
| 244 | Ampli-con347403 | 39064 | 316 | 316 | SNP | C | mo17 | T | b73 | | | | |
| 245 | Ampli-con347403 | 39266 | 89 | 93 | IND | ****** | b73 | CTCCC | mo17 | | | | |
| 245 | Ampli-con347507 | 39267 | 118 | 118 | SNP | A | mo17 | G | b73 | | | | |
| 245 | Ampli-con347507 | 39268 | 126 | 126 | SNP | C | b73 | T | mo17 | | | | |
| 245 | Ampli-con347507 | 39269 | 165 | 165 | SNP | C | mo17 | T | b73 | | | | |
| 245 | Ampli-con347507 | 39270 | 174 | 174 | SNP | C | b73 | G | mo17 | | | | |
| 245 | Ampli-con347507 | 39271 | 251 | 251 | SNP | G | b73 | T | mo17 | | | | |
| 245 | Ampli-con347507 | 39272 | 306 | 319 | IND | ************** | mo17 | ACCTGACCCGCGGC | b73 | | | | |
| 245 | Ampli-con347507 | 39273 | 306 | 320 | IND | *************** | mo17 | ACCTGACCCGGGCG | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 245 | Ampli-con347507 | 39274 | 361 | 361 | SNP | C | mo17 | G | b73 | | | | |
| 245 | Ampli-con347507 | 39275 | 396 | 396 | SNP | C | b73 | T | mo17 | | | | |
| 245 | Ampli-con347507 | 39276 | 505 | 505 | SNP | C | b73 | G | mo17 | | | | |
| 245 | Ampli-con347507 | 39277 | 507 | 507 | SNP | C | b73 | G | mo17 | | | | |
| 245 | Ampli-con347507 | 39278 | 508 | 508 | SNP | A | b73 | C | mo17 | | | | |
| 245 | Ampli-con347507 | 39279 | 509 | 509 | SNP | A | b73 | G | mo17 | | | | |
| 245 | Ampli-con347507 | 39280 | 510 | 510 | SNP | C | mo17 | G | b73 | | | | |
| 245 | Ampli-con347507 | 39281 | 511 | 511 | SNP | A | mo17 | C | b73 | | | | |
| 245 | Ampli-con347507 | 39282 | 512 | 512 | SNP | G | mo17 | T | b73 | | | | |
| 245 | Ampli-con347507 | 39283 | 516 | 516 | SNP | A | mo17 | T | b73 | | | | |
| 246 | Ampli-con347517 | 39286 | 405 | 405 | SNP | C | b73 | T | mo17 | | | | |
| 246 | Ampli-con347517 | 39287 | 424 | 424 | SNP | A | mo17 | G | b73 | | | | |
| 246 | Ampli-con347517 | 39288 | 436 | 436 | SNP | A | mo17 | G | b73 | | | | |
| 246 | Ampli-con347517 | 39289 | 500 | 500 | SNP | C | b73 | T | mo17 | | | | |
| 247 | Ampli-con347532 | 39348 | 485 | 485 | SNP | A | mo17 | T | b73 | | | | |
| 247 | Ampli-con347532 | 39349 | 488 | 488 | SNP | A | b73 | G | mo17 | | | | |
| 247 | Ampli-con347532 | 39350 | 594 | 594 | SNP | C | mo17 | T | b73 | | | | |
| 247 | Ampli-con347532 | 39351 | 680 | 680 | SNP | A | b73 | G | mo17 | | | | |
| 247 | Ampli-con347532 | 39352 | 700 | 700 | IND | * | mo17 | T | b73 | | | | |
| 247 | Ampli-con347532 | 39353 | 714 | 714 | SNP | G | mo17 | T | b73 | | | | |
| 247 | Ampli-con347532 | 39354 | 729 | 729 | SNP | C | b73 | G | mo17 | | | | |
| 248 | Ampli-con347593 | 39502 | 51 | 51 | SNP | A | b73 | G | mo17 | | | | |
| 249 | Ampli-con347598 | 39507 | 137 | 137 | SNP | C | mo17 | T | b73 | | | | |
| 249 | Ampli-con347598 | 39508 | 433 | 434 | IND | ** | mo17 | CC | b73 | | | | |
| 249 | Ampli-con347598 | 39509 | 477 | 479 | IND | *** | b73 | GCT | mo17 | | | | |
| 249 | Ampli-con347598 | 39510 | 500 | 508 | IND | ********* | b73 | ATGGCAGGC | mo17 | | | | |
| 249 | Ampli-con347598 | 39511 | 559 | 559 | SNP | C | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 250 | Ampli-con347833 | 39773 | 47 | 47 | SNP | C | b73 | T | mo17 | | | | |
| 250 | Ampli-con347833 | 39774 | 91 | 91 | IND | * | mo17 | G | b73 | | | | |
| 250 | Ampli-con347833 | 39775 | 117 | 117 | SNP | A | b73 | T | mo17 | | | | |
| 250 | Ampli-con347833 | 39776 | 153 | 153 | SNP | A | b73 | C | mo17 | | | | |
| 250 | Ampli-con347833 | 39777 | 164 | 164 | SNP | A | b73 | G | mo17 | | | | |
| 250 | Ampli-con347833 | 39778 | 545 | 546 | IND | ** | b73 | TT | mo17 | | | | |
| 250 | Ampli-con347833 | 39779 | 568 | 568 | SNP | C | mo17 | T | b73 | | | | |
| 250 | Ampli-con347833 | 39780 | 579 | 579 | SNP | G | mo17 | T | b73 | | | | |
| 250 | Ampli-con347833 | 39781 | 580 | 580 | SNP | A | b73 | C | mo17 | | | | |
| 250 | Ampli-con347833 | 39782 | 322 | 322 | SNP | C | mo17 | G | b73 | | | | |
| 251 | Ampli-con347845 | 39783 | 359 | 359 | SNP | C | mo17 | T | b73 | | | | |
| 251 | Ampli-con347845 | 39784 | 385 | 385 | SNP | C | mo17 | T | b73 | | | | |
| 251 | Ampli-con347845 | 39785 | 515 | 515 | SNP | G | b73 | T | mo17 | | | | |
| 251 | Ampli-con347845 | 39786 | 569 | 569 | SNP | A | mo17 | C | b73 | | | | |
| 251 | Ampli-con347845 | 39787 | 719 | 719 | IND | * | mo17 | G | b73 | | | | |
| 251 | Ampli-con347845 | 39788 | 724 | 724 | IND | * | mo17 | T | b73 | | | | |
| 252 | Ampli-con347958 | 39886 | 118 | 118 | IND | * | b73 | G | mo17 | | | | |
| 252 | Ampli-con347958 | 39887 | 220 | 220 | SNP | A | b73 | C | mo17 | | | | |
| 252 | Ampli-con347958 | 39888 | 275 | 275 | SNP | C | mo17 | G | b73 | | | | |
| 252 | Ampli-con347958 | 39889 | 290 | 290 | SNP | G | mo17 | T | b73 | | | | |
| 252 | Ampli-con347958 | 39890 | 308 | 308 | SNP | C | mo17 | T | b73 | | | | |
| 252 | Ampli-con347958 | 39891 | 335 | 335 | SNP | C | b73 | G | mo17 | | | | |
| 252 | Ampli-con347958 | 39892 | 379 | 379 | IND | * | mo17 | C | b73 | | | | |
| 252 | Ampli-con347958 | 39893 | 402 | 402 | SNP | A | mo17 | G | b73 | | | | |
| 252 | Ampli-con347958 | 39894 | 435 | 435 | SNP | A | mo17 | C | b73 | | | | |
| 252 | Ampli-con347958 | 39895 | 483 | 483 | SNP | G | mo17 | T | b73 | | | | |
| 252 | Ampli-con347958 | 39896 | 651 | 651 | SNP | A | mo17 | C | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 253 | Amplicon348012 | 39978 | 226 | 226 | SNP | C | b73 | T | mo17 | | | | |
| 254 | Amplicon389945 | 40124 | 212 | 212 | SNP | A | b73 | G | mo17 | | | | |
| 255 | Amplicon390056 | 40189 | 324 | 324 | SNP | C | mo17 | T | b73 | | | | |
| 256 | Amplicon390137 | 40320 | 319 | 319 | SNP | C | b73 | T | mo17 | | | | |
| 257 | Amplicon390154 | 40337 | 106 | 106 | SNP | C | mo17 | G | b73 | | | | |
| 257 | Amplicon390154 | 40338 | 457 | 457 | SNP | G | mo17 | T | b73 | | | | |
| 258 | Amplicon390253 | 40431 | 243 | 243 | SNP | C | b73 | T | mo17 | | | | |
| 258 | Amplicon390253 | 40432 | 245 | 245 | SNP | C | b73 | T | mo17 | | | | |
| 258 | Amplicon390253 | 40433 | 246 | 246 | IND | * | b73 | T | mo17 | | | | |
| 259 | Amplicon390282 | 40451 | 23 | 24 | IND | ** | mo17 | CA | b73 | | | | |
| 259 | Amplicon390282 | 40452 | 28 | 28 | SNP | C | mo17 | G | b73 | | | | |
| 259 | Amplicon390282 | 40453 | 146 | 149 | IND | **** | b73 | CTAG | mo17 | | | | |
| 259 | Amplicon390282 | 40454 | 201 | 204 | IND | **** | b73 | TATA | mo17 | | | | |
| 259 | Amplicon390282 | 40455 | 222 | 222 | SNP | A | b73 | G | mo17 | | | | |
| 259 | Amplicon390282 | 40456 | 242 | 242 | SNP | A | mo17 | T | b73 | | | | |
| 259 | Amplicon390282 | 40457 | 266 | 266 | SNP | C | mo17 | T | b73 | | | | |
| 259 | Amplicon390282 | 40458 | 270 | 270 | SNP | C | mo17 | T | b73 | | | | |
| 259 | Amplicon390282 | 40459 | 296 | 296 | SNP | A | mo17 | C | b73 | | | | |
| 259 | Amplicon390282 | 40460 | 309 | 311 | IND | *** | mo17 | TTT | b73 | | | | |
| 259 | Amplicon390282 | 40461 | 365 | 365 | SNP | A | mo17 | T | b73 | | | | |
| 259 | Amplicon390282 | 40462 | 395 | 395 | SNP | A | mo17 | G | b73 | | | | |
| 259 | Amplicon390282 | 40463 | 399 | 399 | SNP | * | b73 | A | mo17 | | | | |
| 259 | Amplicon390282 | 40464 | 399 | 400 | IND | ** | b73 | AT | mo17 | | | | |
| 260 | Amplicon390291 | 40473 | 281 | 281 | SNP | A | mo17 | C | b73 | | | | |
| 260 | Amplicon390291 | 40474 | 397 | 397 | IND | * | mo17 | C | b73 | | | | |
| 260 | Amplicon390291 | 40475 | 407 | 407 | SNP | C | mo17 | T | b73 | | | | |
| 260 | Amplicon390291 | 40476 | 408 | 408 | SNP | A | b73 | C | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 260 | Ampli-con390291 | 40477 | 409 | 409 | IND | * | mo17 | T | b73 | | | | |
| 260 | Ampli-con390291 | 40478 | 417 | 418 | IND | ** | mo17 | CA | b73 | | | | |
| 261 | Ampli-con390465 | 40655 | 58 | 58 | SNP | A | b73 | G | mo17 | | | | |
| 262 | Ampli-con390649 | 40931 | 355 | 357 | IND | *** | b73 | CTT | mo17 | | | | |
| 263 | Ampli-con390853 | 41280 | 224 | 224 | SNP | C | mo17 | T | b73 | | | | |
| 263 | Ampli-con390853 | 41281 | 283 | 283 | SNP | C | mo17 | G | b73 | | | | |
| 264 | Ampli-con391267 | 41850 | 54 | 54 | SNP | C | b73 | T | mo17 | | | | |
| 264 | Ampli-con391267 | 41851 | 111 | 111 | SNP | A | mo17 | G | b73 | | | | |
| 264 | Ampli-con391267 | 41852 | 119 | 119 | SNP | A | mo17 | T | b73 | | | | |
| 265 | Ampli-con391526 | 42161 | 133 | 133 | SNP | G | b73 | T | mo17 | | | | |
| 265 | Ampli-con391526 | 42162 | 193 | 193 | SNP | A | mo17 | G | b73 | | | | |
| 265 | Ampli-con391526 | 42163 | 253 | 253 | SNP | A | b73 | G | mo17 | | | | |
| 265 | Ampli-con391526 | 42164 | 319 | 319 | SNP | A | mo17 | G | b73 | | | | |
| 265 | Ampli-con391526 | 42165 | 349 | 349 | SNP | C | mo17 | T | b73 | | | | |
| 265 | Ampli-con391526 | 42166 | 373 | 373 | SNP | A | b73 | G | mo17 | | | | |
| 266 | Ampli-con391532 | 42173 | 90 | 91 | IND | ** | mo17 | TA | b73 | | | | |
| 266 | Ampli-con391532 | 42174 | 122 | 122 | IND | * | b73 | G | mo17 | | | | |
| 266 | Ampli-con391532 | 42175 | 128 | 129 | IND | ** | b73 | AA | mo17 | | | | |
| 266 | Ampli-con391532 | 42176 | 237 | 238 | IND | ** | mo17 | GC | b73 | | | | |
| 266 | Ampli-con391532 | 42177 | 278 | 286 | IND | ********** | mo17 | GCCTTGTTG | b73 | | | | |
| 266 | Ampli-con391532 | 42178 | 317 | 318 | IND | ** | b73 | CT | mo17 | | | | |
| 266 | Ampli-con391532 | 42179 | 320 | 323 | IND | **** | b73 | CGAC | mo17 | | | | |
| 266 | Ampli-con391532 | 42180 | 334 | 334 | SNP | C | mo17 | G | b73 | | | | |
| 266 | Ampli-con391532 | 42181 | 345 | 347 | IND | *** | b73 | CTA | mo17 | | | | |
| 266 | Ampli-con391532 | 42182 | 360 | 360 | SNP | A | mo17 | G | b73 | | | | |
| 266 | Ampli-con391532 | 42183 | 371 | 371 | IND | * | b73 | G | mo17 | | | | |
| 266 | Ampli-con391532 | 42184 | 375 | 375 | IND | * | b73 | A | mo17 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 266 | Ampli-con391532 | 42185 | 383 | 383 | SNP | G | b73 | T | mo17 | | | | |
| 266 | Ampli-con391532 | 42186 | 400 | 400 | SNP | A | mo17 | T | b73 | | | | |
| 266 | Ampli-con391532 | 42187 | 405 | 405 | IND | * | b73 | A | mo17 | | | | |
| 266 | Ampli-con391532 | 42188 | 414 | 416 | IND | *** | b73 | ATA | mo17 | | | | |
| 266 | Ampli-con391532 | 42189 | 433 | 433 | SNP | A | b73 | T | mo17 | | | | |
| 266 | Ampli-con391532 | 42190 | 443 | 446 | IND | **** | b73 | TGTA | mo17 | | | | |
| 266 | Ampli-con391532 | 42191 | 448 | 448 | IND | * | b73 | C | mo17 | | | | |
| 267 | Ampli-con437734 | 42930 | 136 | 136 | SNP | A | mo17 | C | b73 | | | | |
| 267 | Ampli-con437734 | 42931 | 195 | 195 | SNP | C | b73 | T | mo17 | | | | |
| 267 | Ampli-con437734 | 42932 | 297 | 297 | SNP | A | b73 | G | mo17 | | | | |
| 267 | Ampli-con437734 | 42933 | 338 | 338 | SNP | A | b73 | G | mo17 | | | | |
| 267 | Ampli-con437734 | 42934 | 421 | 421 | SNP | A | b73 | T | mo17 | | | | |
| 267 | Ampli-con437734 | 42935 | 427 | 427 | SNP | C | b73 | G | mo17 | | | | |
| 268 | Ampli-con437882 | 43119 | 80 | 80 | SNP | C | b73 | T | mo17 | | | | |
| 268 | Ampli-con437882 | 43120 | 141 | 141 | SNP | C | b73 | G | mo17 | | | | |
| 268 | Ampli-con437882 | 43121 | 310 | 310 | SNP | A | b73 | G | mo17 | | | | |
| 268 | Ampli-con437882 | 43122 | 354 | 354 | SNP | C | b73 | G | b73 | | | | |
| 268 | Ampli-con437882 | 43123 | 410 | 410 | SNP | A | mo17 | G | b73 | | | | |
| 269 | Ampli-con437962 | 43220 | 44 | 44 | SNP | G | mo17 | T | b73 | | | | |
| 269 | Ampli-con437962 | 43221 | 73 | 76 | IND | **** | mo17 | CTAG | b73 | | | | |
| 269 | Ampli-con437962 | 43222 | 114 | 114 | SNP | C | mo17 | T | mo17 | | | | |
| 269 | Ampli-con437962 | 43223 | 119 | 119 | IND | * | b73 | C | mo17 | | | | |
| 269 | Ampli-con437962 | 43224 | 206 | 206 | IND | * | b73 | G | mo17 | | | | |
| 269 | Ampli-con437962 | 43225 | 208 | 208 | SNP | A | b73 | C | mo17 | | | | |
| 269 | Ampli-con437962 | 43226 | 209 | 209 | SNP | C | mo17 | G | b73 | | | | |
| 269 | Ampli-con437962 | 43227 | 220 | 220 | SNP | A | mo17 | G | b73 | | | | |
| 269 | Ampli-con437962 | 43228 | 452 | 455 | IND | **** | mo17 | ATAC | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 269 | Ampli-con437962 | 43229 | 533 | 533 | SNP | C | b73 | T | mo17 | | | | |
| 269 | Ampli-con437962 | 43230 | 649 | 649 | SNP | C | b73 | G | mo17 | | | | |
| 270 | Ampli-con438229 | 43576 | 47 | 47 | SNP | A | b73 | T | mo17 | | | | |
| 270 | Ampli-con438229 | 43577 | 48 | 48 | SNP | A | b73 | T | mo17 | | | | |
| 270 | Ampli-con438229 | 43578 | 71 | 71 | SNP | A | mo17 | T | b73 | | | | |
| 270 | Ampli-con438229 | 43579 | 153 | 153 | SNP | C | b73 | T | mo17 | | | | |
| 270 | Ampli-con438229 | 43580 | 217 | 217 | SNP | C | b73 | T | mo17 | | | | |
| 270 | Ampli-con438229 | 43581 | 274 | 274 | SNP | A | mo17 | C | b73 | | | | |
| 271 | Ampli-con438421 | 43789 | 109 | 109 | SNP | C | b73 | T | mo17 | | | | |
| 272 | Ampli-con557338 | 48404 | 106 | 106 | SNP | C | mo17 | G | b73 | | | | |
| 272 | Ampli-con557338 | 48405 | 137 | 137 | SNP | A | b73 | C | mo17 | | | | |
| 272 | Ampli-con557338 | 48406 | 142 | 142 | SNP | G | b73 | T | mo17 | | | | |
| 272 | Ampli-con557338 | 48407 | 175 | 175 | SNP | C | b73 | C | mo17 | | | | |
| 272 | Ampli-con557338 | 48408 | 192 | 192 | SNP | C | mo17 | T | b73 | | | | |
| 272 | Ampli-con557338 | 48409 | 193 | 193 | SNP | C | mo17 | T | b73 | | | | |
| 272 | Ampli-con557338 | 48410 | 203 | 207 | IND | ****** | mo17 | TGAAT | b73 | | | | |
| 272 | Ampli-con557338 | 48412 | 215 | 215 | SNP | A | b73 | C | mo17 | | | | |
| 272 | Ampli-con557338 | 48413 | 223 | 228 | IND | ****** | mo17 | TATCCA | b73 | | | | |
| 272 | Ampli-con557338 | 48414 | 256 | 256 | SNP | A | mo17 | T | b73 | | | | |
| 272 | Ampli-con557338 | 48415 | 266 | 266 | SNP | C | mo17 | T | b73 | | | | |
| 272 | Ampli-con557338 | 48416 | 317 | 317 | SNP | A | mo17 | C | b73 | | | | |
| 272 | Ampli-con557338 | 48417 | 356 | 356 | SNP | A | mo17 | T | b73 | | | | |
| 272 | Ampli-con557338 | 48418 | 365 | 365 | SNP | A | b73 | C | mo17 | | | | |
| 272 | Ampli-con557338 | 48419 | 366 | 366 | IND | * | b73 | G | mo17 | | | | |
| 272 | Ampli-con557338 | 48420 | 370 | 370 | SNP | C | b73 | T | mo17 | | | | |
| 272 | Ampli-con557338 | 48421 | 401 | 401 | SNP | G | mo17 | T | b73 | | | | |
| 272 | Ampli-con557338 | 48423 | 407 | 408 | IND | ** | mo17 | TT | b73 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 272 | Ampli-con557338 | 48424 | 417 | 417 | SNP | C | mo17 | G | b73 | | | | |
| 272 | Ampli-con557338 | 48425 | 487 | 487 | SNP | C | mo17 | T | b73 | | | | |
| 272 | Ampli-con557338 | 48426 | 491 | 491 | IND | * | mo17 | C | b73 | | | | |
| 272 | Ampli-con557338 | 48427 | 528 | 531 | IND | **** | mo17 | CAGC | b73 | | | | |
| 273 | Ampli-con557363 | 48561 | 27 | 27 | SNP | C | b73 | T | mo17 | | | | |
| 273 | Ampli-con557363 | 48562 | 216 | 216 | SNP | G | mo17 | T | b73 | | | | |
| 274 | Ampli-con557374 | 48615 | 33 | 33 | SNP | C | mo17 | T | b73 | | | | |
| 274 | Ampli-con557374 | 48616 | 87 | 87 | SNP | C | mo17 | T | b73 | | | | |
| 275 | Ampli-con557514 | 49292 | 161 | 161 | SNP | C | mo17 | T | b73 | | | | |
| 275 | Ampli-con557514 | 49293 | 182 | 182 | SNP | A | mo17 | C | b73 | | | | |
| 275 | Ampli-con557514 | 49294 | 185 | 185 | SNP | A | b73 | G | mo17 | | | | |
| 275 | Ampli-con557514 | 49295 | 222 | 222 | SNP | A | b73 | G | mo17 | | | | |
| 275 | Ampli-con557514 | 49296 | 223 | 223 | SNP | A | b73 | G | mo17 | | | | |
| 275 | Ampli-con557514 | 49297 | 242 | 242 | SNP | G | b73 | T | mo17 | | | | |
| 275 | Ampli-con557514 | 49298 | 295 | 295 | SNP | C | mo17 | T | b73 | | | | |
| 275 | Ampli-con557514 | 49299 | 371 | 371 | SNP | C | b73 | G | mo17 | | | | |
| 275 | Ampli-con557514 | 49301 | 448 | 448 | SNP | C | mo17 | T | b73 | | | | |
| 276 | Ampli-con557514 | 49557 | 463 | 463 | SNP | A | mo17 | G | b73 | | | | |
| 277 | Ampli-con557572 | 50315 | 255 | 255 | SNP | A | mo17 | G | b73 | | | | |
| 277 | Ampli-con557793 | 50316 | 355 | 355 | SNP | A | mo17 | G | b73 | | | | |
| 278 | Ampli-con557793 | 51399 | 37 | 43 | IND | ******* | mo17 | TCAGTGG | b73 | | | | |
| 278 | Ampli-con558092 | 51400 | 178 | 178 | SNP | A | mo17 | T | b73 | | | | |
| 278 | Ampli-con558092 | 51401 | 179 | 179 | SNP | A | mo17 | C | b73 | | | | |
| 278 | Ampli-con558092 | 51402 | 234 | 234 | SNP | A | mo17 | C | b73 | | | | |
| 278 | Ampli-con558092 | 51403 | 278 | 278 | SNP | A | mo17 | C | b73 | | | | |
| 278 | Ampli-con558092 | 51404 | 284 | 284 | SNP | C | mo17 | T | b73 | | | | |
| 278 | Ampli-con558092 | 51405 | 327 | 327 | SNP | C | mo17 | T | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 279 | Ampli-con558095 | 51419 | 251 | 251 | SNP | C | b73 | T | mo17 | | | | |
| 280 | Ampli-con558139 | 51609 | 45 | 45 | SNP | A | b73 | T | mo17 | | | | |
| 280 | Ampli-con558139 | 51610 | 196 | 196 | SNP | C | b73 | G | mo17 | | | | |
| 280 | Ampli-con558139 | 51611 | 200 | 200 | SNP | C | mo17 | T | b73 | | | | |
| 280 | Ampli-con558139 | 51613 | 270 | 270 | SNP | A | mo17 | G | b73 | | | | |
| 280 | Ampli-con558139 | 51614 | 319 | 319 | SNP | C | b73 | T | mo17 | | | | |
| 281 | Ampli-con558289 | 52078 | 104 | 104 | IND | * | mo17 | G | b73 | | | | |
| 281 | Ampli-con558289 | 52080 | 106 | 106 | IND | * | mo17 | C | b73 | | | | |
| 281 | Ampli-con558289 | 52081 | 350 | 350 | SNP | C | b73 | T | mo17 | | | | |
| 282 | Ampli-con558289 | 53097 | 334 | 334 | SNP | A | mo17 | T | b73 | | | | |
| 283 | Ampli-con558536 | 53899 | 472 | 473 | IND | ** | mo17 | TA | b73 | | | | |
| 284 | Ampli-con558731 | 54409 | 76 | 76 | SNP | C | mo17 | T | b73 | | | | |
| 284 | Ampli-con558865 | 54410 | 100 | 100 | SNP | C | mo17 | T | b73 | | | | |
| 284 | Ampli-con558865 | 54411 | 110 | 110 | SNP | A | mo17 | G | b73 | | | | |
| 284 | Ampli-con558865 | 54412 | 444 | 444 | SNP | A | b73 | T | mo17 | | | | |
| 284 | Ampli-con558865 | 54413 | 478 | 478 | SNP | A | b73 | G | mo17 | | | | |
| 285 | Ampli-con558865 | 54460 | 410 | 410 | SNP | A | mo17 | T | b73 | | | | |
| 286 | Ampli-con558883 | 55370 | 254 | 254 | SNP | C | b73 | T | mo17 | | | | |
| 286 | Ampli-con559082 | 55371 | 354 | 354 | SNP | C | b73 | T | mo17 | | | | |
| 286 | Ampli-con559082 | 55372 | 355 | 355 | SNP | G | mo17 | T | b73 | | | | |
| 286 | Ampli-con559082 | 55373 | 418 | 418 | IND | * | mo17 | C | b73 | | | | |
| 286 | Ampli-con559082 | 55374 | 490 | 490 | SNP | A | mo17 | T | b73 | | | | |
| 287 | Ampli-con559082 | 56934 | 179 | 179 | SNP | G | mo17 | T | b73 | | | | |
| 287 | Ampli-con559441 | 56935 | 212 | 212 | SNP | C | mo17 | T | b73 | | | | |
| 287 | Ampli-con559441 | 56936 | 240 | 240 | SNP | C | mo17 | T | b73 | | | | |
| 287 | Ampli-con559441 | 56937 | 258 | 258 | SNP | G | mo17 | T | b73 | | | | |
| 287 | Ampli-con559441 | 56938 | 383 | 383 | SNP | C | b73 | T | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 287 | Ampli-con559441 | 56939 | 425 | 425 | SNP | A | b73 | C | mo17 | | | | |
| 288 | Ampli-con559491 | 57136 | 129 | 129 | SNP | G | b73 | T | mo17 | | | | |
| 288 | Ampli-con559491 | 57137 | 540 | 540 | SNP | A | b73 | G | mo17 | | | | |
| 289 | Ampli-con559625 | 57758 | 45 | 45 | SNP | A | b73 | G | mo17 | | | | |
| 290 | Ampli-con559759 | 58375 | 493 | 493 | SNP | C | mo17 | T | b73 | | | | |
| 291 | Ampli-con559897 | 58904 | 119 | 119 | SNP | C | b73 | G | mo17 | | | | |
| 291 | Ampli-con559897 | 58905 | 215 | 215 | SNP | A | mo17 | T | b73 | | | | |
| 291 | Ampli-con559897 | 58906 | 313 | 313 | SNP | A | b73 | T | mo17 | | | | |
| 292 | Ampli-con559922 | 59006 | 21 | 21 | SNP | A | b73 | T | mo17 | | | | |
| 292 | Ampli-con559922 | 59007 | 33 | 33 | SNP | C | b73 | G | mo17 | | | | |
| 292 | Ampli-con559922 | 59008 | 82 | 82 | SNP | C | mo17 | T | b73 | | | | |
| 292 | Ampli-con559922 | 59009 | 183 | 183 | SNP | A | b73 | C | mo17 | | | | |
| 292 | Ampli-con559922 | 59010 | 233 | 233 | SNP | G | b73 | T | mo17 | | | | |
| 292 | Ampli-con559922 | 59011 | 260 | 260 | SNP | C | mo17 | T | b73 | | | | |
| 293 | Ampli-con560273 | 60430 | 62 | 62 | SNP | A | mo17 | G | b73 | | | | |
| 293 | Ampli-con560273 | 60431 | 81 | 81 | IND | * | mo17 | T | b73 | | | | |
| 293 | Ampli-con560273 | 60433 | 143 | 143 | SNP | A | b73 | C | mo17 | | | | |
| 293 | Ampli-con560273 | 60434 | 165 | 165 | IND | * | mo17 | T | b73 | | | | |
| 294 | Ampli-con560371 | 60751 | 298 | 298 | SNP | A | mo17 | G | b73 | | | | |
| 294 | Ampli-con560371 | 60753 | 370 | 370 | SNP | A | mo17 | T | b73 | | | | |
| 294 | Ampli-con560371 | 60754 | 375 | 375 | SNP | A | b73 | C | mo17 | | | | |
| 294 | Ampli-con560371 | 60755 | 444 | 444 | SNP | A | mo17 | T | b73 | | | | |
| 295 | Ampli-con617328 | 68149 | 297 | 297 | SNP | C | b73 | T | mo17 | | | | |
| 295 | Ampli-con617328 | 68150 | 598 | 598 | SNP | C | mo17 | G | b73 | | | | |
| 296 | Ampli-con617436 | 68421 | 153 | 153 | SNP | C | b73 | T | mo17 | | | | |
| 296 | Ampli-con617436 | 68422 | 180 | 180 | SNP | C | b73 | T | mo17 | | | | |
| 296 | Ampli-con617436 | 68423 | 252 | 252 | SNP | A | b73 | G | mo17 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 296 | Ampli-con617436 | 68424 | 304 | 304 | SNP | C | b73 | T | mo17 | | | | |
| 296 | Ampli-con617436 | 68425 | 363 | 363 | SNP | A | mo17 | G | b73 | | | | |
| 296 | Ampli-con617436 | 68426 | 434 | 434 | SNP | C | mo17 | T | b73 | | | | |
| 296 | Ampli-con617436 | 68427 | 459 | 459 | SNP | C | mo17 | T | b73 | | | | |
| 297 | Ampli-con617439 | 68435 | 54 | 54 | SNP | A | mo17 | G | b73 | | | | |
| 297 | Ampli-con617439 | 68436 | 80 | 80 | SNP | A | mo17 | C | b73 | | | | |
| 297 | Ampli-con617439 | 68437 | 93 | 93 | SNP | A | mo17 | G | b73 | | | | |
| 297 | Ampli-con617439 | 68438 | 123 | 123 | SNP | C | b73 | T | mo17 | | | | |
| 297 | Ampli-con617439 | 68439 | 161 | 161 | SNP | C | b73 | T | mo17 | | | | |
| 297 | Ampli-con617439 | 68440 | 536 | 536 | SNP | C | b73 | G | mo17 | | | | |
| 298 | Ampli-con617662 | 68940 | 113 | 113 | SNP | C | b73 | T | mo17 | | | | |
| 298 | Ampli-con617662 | 68941 | 277 | 277 | SNP | C | mo17 | G | b73 | | | | |
| 298 | Ampli-con617662 | 68942 | 393 | 397 | IND | ***** | b73 | ACGCT | mo17 | | | | |
| 298 | Ampli-con617662 | 68943 | 435 | 435 | IND | * | mo17 | C | b73 | | | | |
| 298 | Ampli-con617662 | 68944 | 436 | 445 | IND | ********** | mo17 | CTTCTAAGAC | b73 | | | | |
| 299 | Ampli-con617671 | 68950 | 126 | 126 | SNP | G | b73 | T | mo17 | | | | |
| 299 | Ampli-con617671 | 68952 | 172 | 172 | SNP | A | b73 | G | mo17 | | | | |
| 299 | Ampli-con617671 | 68953 | 182 | 182 | SNP | C | b73 | T | mo17 | | | | |
| 299 | Ampli-con617671 | 68954 | 214 | 214 | SNP | G | mo17 | T | b73 | | | | |
| 299 | Ampli-con617671 | 68955 | 260 | 260 | SNP | C | b73 | T | mo17 | | | | |
| 299 | Ampli-con617671 | 68956 | 282 | 282 | SNP | C | b73 | T | mo17 | | | | |
| 299 | Ampli-con617671 | 68957 | 285 | 285 | SNP | C | b73 | T | mo17 | | | | |
| 299 | Ampli-con617671 | 68958 | 287 | 287 | SNP | C | mo17 | G | b73 | | | | |
| 299 | Ampli-con617671 | 68959 | 300 | 300 | SNP | C | b73 | T | mo17 | | | | |
| 299 | Ampli-con617671 | 68960 | 327 | 327 | SNP | C | mo17 | T | b73 | | | | |
| 299 | Ampli-con617671 | 68961 | 414 | 414 | SNP | C | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 299 | Ampli-con617671 | 68962 | 435 | 435 | SNP | A | b73 | G | mo17 | | | | |
| 300 | Ampli-con617706 | 69119 | 200 | 200 | SNP | C | mo17 | T | b73 | | | | |
| 300 | Ampli-con617706 | 69120 | 471 | 471 | SNP | C | mo17 | G | b73 | | | | |
| 300 | Ampli-con617706 | 69121 | 684 | 684 | SNP | A | mo17 | G | b73 | | | | |
| 300 | Ampli-con617706 | 69122 | 743 | 743 | SNP | C | mo17 | T | b73 | | | | |
| 300 | Ampli-con617706 | 69123 | 749 | 749 | IND | * | mo17 | G | b73 | | | | |
| 300 | Ampli-con617706 | 69125 | 754 | 754 | IND | * | mo17 | A | b73 | | | | |
| 301 | Ampli-con617780 | 69188 | 171 | 171 | SNP | A | b73 | G | mo17 | | | | |
| 302 | Ampli-con617951 | 69556 | 98 | 98 | IND | * | mo17 | T | b73 | | | | |
| 302 | Ampli-con617951 | 69557 | 100 | 100 | SNP | A | mo17 | G | b73 | | | | |
| 302 | Ampli-con617951 | 69558 | 179 | 179 | SNP | G | b73 | T | mo17 | | | | |
| 302 | Ampli-con617951 | 69559 | 202 | 202 | SNP | C | mo17 | T | b73 | | | | |
| 302 | Ampli-con617951 | 69562 | 240 | 240 | SNP | C | b73 | G | mo17 | | | | |
| 302 | Ampli-con617951 | 69563 | 261 | 261 | SNP | A | mo17 | G | b73 | | | | |
| 302 | Ampli-con617951 | 69565 | 590 | 590 | SNP | A | mo17 | G | b73 | | | | |
| 303 | Ampli-con617978 | 69588 | 244 | 244 | SNP | C | b73 | T | mo17 | | | | |
| 303 | Ampli-con617978 | 69589 | 264 | 264 | SNP | G | b73 | T | mo17 | | | | |
| 303 | Ampli-con617978 | 69590 | 282 | 282 | SNP | C | b73 | T | mo17 | | | | |
| 303 | Ampli-con617978 | 69591 | 349 | 349 | SNP | C | mo17 | T | b73 | | | | |
| 303 | Ampli-con617978 | 69592 | 438 | 439 | IND | ** | b73 | AT | mo17 | | | | |
| 303 | Ampli-con617978 | 69593 | 540 | 540 | SNP | A | mo17 | C | b73 | | | | |
| 303 | Ampli-con617978 | 69594 | 541 | 541 | SNP | A | mo17 | T | b73 | | | | |
| 303 | Ampli-con617978 | 69595 | 585 | 585 | SNP | A | b73 | G | mo17 | | | | |
| 304 | Ampli-con617990 | 69630 | 598 | 598 | SNP | A | b73 | G | mo17 | | | | |
| 305 | Ampli-con645093 | 70727 | 140 | 140 | SNP | C | b73 | T | mo17 | | | | |
| 305 | Ampli-con645093 | 70728 | 178 | 178 | SNP | C | b73 | T | mo17 | | | | |
| 305 | Ampli-con645093 | 70730 | 330 | 330 | SNP | C | mo17 | G | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 305 | Ampli-con645093 | 70731 | 944 | 944 | SNP | A | mo17 | C | b73 | | | | |
| 305 | Ampli-con645093 | 70732 | 979 | 979 | SNP | A | b73 | G | mo17 | | | | |
| 305 | Ampli-con645093 | 70733 | 1060 | 1060 | SNP | A | b73 | T | mo17 | | | | |
| 305 | Ampli-con645093 | 70734 | 1095 | 1095 | SNP | C | b73 | G | mo17 | | | | |
| 306 | Ampli-con645093 | 71154 | 300 | 302 | IND | *** | b73 | TGA | mo17 | | | | |
| 306 | Ampli-con645262 | 71156 | 400 | 400 | SNP | A | mo17 | C | b73 | | | | |
| 306 | Ampli-con645262 | 71157 | 621 | 626 | IND | ****** | b73 | ATACTT | mo17 | | | | |
| 306 | Ampli-con645262 | 71158 | 779 | 779 | SNP | G | mo17 | T | b73 | | | | |
| 306 | Ampli-con645262 | 71159 | 902 | 903 | IND | ** | mo17 | TG | b73 | | | | |
| 307 | Ampli-con645495 | 71622 | 51 | 51 | SNP | A | mo17 | G | b73 | | | | |
| 307 | Ampli-con645495 | 71623 | 52 | 52 | SNP | A | mo17 | G | b73 | | | | |
| 307 | Ampli-con645495 | 71624 | 105 | 105 | SNP | A | b73 | G | mo17 | | | | |
| 307 | Ampli-con645495 | 71625 | 127 | 127 | SNP | A | b73 | C | mo17 | | | | |
| 307 | Ampli-con645495 | 71627 | 138 | 140 | IND | *** | mo17 | AAA | b73 | | | | |
| 307 | Ampli-con645495 | 71628 | 219 | 219 | SNP | C | b73 | T | mo17 | | | | |
| 307 | Ampli-con645495 | 71629 | 348 | 348 | SNP | A | mo17 | G | b73 | | | | |
| 307 | Ampli-con645495 | 71630 | 551 | 551 | SNP | A | mo17 | T | b73 | | | | |
| 307 | Ampli-con645495 | 71633 | 784 | 784 | SNP | G | b73 | T | mo17 | | | | |
| 307 | Ampli-con645495 | 71634 | 794 | 794 | SNP | A | mo17 | G | b73 | | | | |
| 307 | Ampli-con645495 | 71635 | 824 | 824 | SNP | C | b73 | T | mo17 | | | | |
| 307 | Ampli-con645495 | 71639 | 931 | 931 | SNP | C | b73 | T | mo17 | | | | |
| 307 | Ampli-con645495 | 71640 | 975 | 975 | SNP | A | mo17 | C | b73 | | | | |
| 308 | Ampli-con645495 | 76792 | 194 | 194 | SNP | A | b73 | G | mo17 | | | | |
| 308 | Ampli-con670815 | 76793 | 291 | 291 | SNP | C | b73 | T | mo17 | | | | |
| 309 | Ampli-con670815 | 77118 | 187 | 187 | SNP | A | mo17 | G | b73 | | | | |
| 310 | Ampli-con670910 | 77412 | 88 | 88 | SNP | G | mo17 | T | b73 | | | | |
| 310 | Ampli-con670989 | 77413 | 118 | 118 | SNP | G | mo17 | T | b73 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 310 | Amplicon670989 | 77414 | 245 | 245 | SNP | C | b73 | T | mo17 | | | | |
| 311 | Amplicon671032 | 77545 | 66 | 66 | SNP | A | b73 | G | mo17 | | | | |
| 312 | Amplicon671043 | 77568 | 249 | 249 | SNP | A | mo17 | G | b73 | | | | |
| 313 | Amplicon671315 | 78437 | 94 | 94 | SNP | C | mo17 | G | b73 | | | | |
| 313 | Amplicon671315 | 78438 | 137 | 137 | SNP | C | b73 | T | mo17 | | | | |
| 314 | Amplicon700255 | 78827 | 122 | 122 | SNP | A | b73 | G | mo17 | | | | |
| 314 | Amplicon700255 | 78828 | 209 | 209 | SNP | C | b73 | T | mo17 | | | | |
| 314 | Amplicon700255 | 78829 | 262 | 266 | IND | ***** | b73 | GTGTG | mo17 | | | | |
| 314 | Amplicon700255 | 78830 | 292 | 292 | IND | * | b73 | T | mo17 | | | | |
| 315 | Amplicon700287 | 79073 | 97 | 97 | SNP | A | mo17 | G | b73 | | | | |
| 316 | Amplicon700291 | 79081 | 79 | 79 | SNP | A | mo17 | C | b73 | | | | |
| 316 | Amplicon700291 | 79082 | 164 | 164 | SNP | A | b73 | G | mo17 | | | | |
| 317 | Amplicon700342 | 79300 | 202 | 202 | SNP | C | b73 | T | mo17 | | | | |
| 317 | Amplicon700342 | 79301 | 223 | 223 | SNP | C | b73 | T | mo17 | | | | |
| 317 | Amplicon700342 | 79303 | 250 | 250 | SNP | A | b73 | T | mo17 | | | | |
| 317 | Amplicon700342 | 79304 | 252 | 252 | SNP | C | mo17 | G | b73 | | | | |
| 317 | Amplicon700342 | 79305 | 297 | 297 | SNP | A | b73 | T | mo17 | | | | |
| 317 | Amplicon700342 | 79306 | 321 | 321 | SNP | A | mo17 | G | b73 | | | | |
| 317 | Amplicon700342 | 79307 | 373 | 373 | IND | * | b73 | T | mo17 | | | | |
| 318 | Amplicon700384 | 79514 | 80 | 80 | SNP | A | b73 | G | mo17 | | | | |
| 318 | Amplicon700384 | 79515 | 255 | 255 | IND | * | b73 | T | mo17 | | | | |
| 318 | Amplicon700384 | 79516 | 307 | 307 | SNP | A | b73 | G | mo17 | | | | |
| 318 | Amplicon700384 | 79517 | 321 | 321 | SNP | A | b73 | G | mo17 | | | | |
| 318 | Amplicon700384 | 79518 | 448 | 448 | SNP | A | mo17 | G | b73 | | | | |
| 318 | Amplicon700384 | 79519 | 480 | 480 | SNP | C | b73 | T | mo17 | | | | |
| 319 | Amplicon700387 | 79529 | 130 | 130 | SNP | A | mo17 | T | b73 | | | | |
| 320 | Amplicon700428 | 79693 | 127 | 127 | SNP | C | mo17 | T | b73 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 320 | Amplicon700428 | 79694 | 159 | 159 | SNP | C | b73 | T | mo17 | | | | |
| 320 | Amplicon700428 | 79695 | 204 | 204 | SNP | G | b73 | T | mo17 | | | | |
| 320 | Amplicon700428 | 79696 | 220 | 220 | IND | * | b73 | T | mo17 | | | | |
| 320 | Amplicon700428 | 79697 | 253 | 253 | SNP | C | mo17 | T | b73 | | | | |
| 320 | Amplicon700428 | 79698 | 255 | 255 | SNP | A | b73 | C | mo17 | | | | |
| 320 | Amplicon700428 | 79701 | 456 | 456 | SNP | A | mo17 | G | b73 | | | | |
| 320 | Amplicon700428 | 79702 | 464 | 464 | SNP | A | mo17 | T | b73 | | | | |
| 321 | Amplicon700512 | 80029 | 50 | 50 | SNP | C | b73 | T | mo17 | | | | |
| 321 | Amplicon700512 | 80030 | 86 | 86 | SNP | A | b73 | T | mo17 | | | | |
| 321 | Amplicon700512 | 80031 | 163 | 163 | SNP | A | mo17 | G | b73 | | | | |
| 321 | Amplicon700512 | 80032 | 260 | 260 | SNP | A | mo17 | G | b73 | | | | |
| 321 | Amplicon700512 | 80033 | 269 | 269 | SNP | C | b73 | T | mo17 | | | | |
| 321 | Amplicon700512 | 80034 | 419 | 419 | SNP | C | b73 | G | mo17 | | | | |
| 321 | Amplicon700512 | 80035 | 458 | 458 | SNP | A | b73 | G | mo17 | | | | |
| 322 | Amplicon700579 | 80475 | 229 | 229 | SNP | A | mo17 | G | b73 | | | | |
| 323 | Amplicon700609 | 80704 | 102 | 102 | SNP | C | mo17 | T | b73 | | | | |
| 323 | Amplicon700609 | 80705 | 281 | 281 | SNP | C | mo17 | G | b73 | | | | |
| 324 | Amplicon700771 | 81460 | 110 | 115 | IND | ******* | mo17 | GACGTA | b73 | | | | |
| 324 | Amplicon700771 | 81461 | 129 | 129 | SNP | C | b73 | T | mo17 | | | | |
| 324 | Amplicon700771 | 81462 | 157 | 157 | SNP | C | mo17 | G | b73 | | | | |
| 324 | Amplicon700771 | 81463 | 195 | 195 | IND | * | mo17 | G | b73 | | | | |
| 324 | Amplicon700771 | 81464 | 203 | 203 | IND | * | mo17 | T | b73 | | | | |
| 324 | Amplicon700771 | 81466 | 207 | 207 | IND | * | mo17 | A | b73 | | | | |
| 324 | Amplicon700771 | 81467 | 260 | 260 | IND | * | b73 | T | mo17 | | | | |
| 324 | Amplicon700771 | 81469 | 264 | 265 | IND | ** | b73 | GG | mo17 | | | | |
| 324 | Amplicon700771 | 81470 | 266 | 266 | SNP | G | mo17 | T | b73 | | | | |
| 324 | Amplicon700771 | 81471 | 315 | 318 | IND | **** | b73 | GGAG | mo17 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 325 | Ampli-con724218 | 82235 | 506 | 506 | SNP | A | mo17 | C | b73 | | | | |
| 326 | Ampli-con724245 | 82295 | 252 | 252 | SNP | C | mo17 | T | b73 | | | | |
| 326 | Ampli-con724245 | 82296 | 508 | 508 | SNP | A | b73 | G | mo17 | | | | |
| 327 | Ampli-con724279 | 82454 | 156 | 156 | SNP | A | mo17 | C | b73 | | | | |
| 327 | Ampli-con724279 | 82455 | 203 | 203 | SNP | C | b73 | G | mo17 | | | | |
| 327 | Ampli-con724279 | 82456 | 280 | 280 | SNP | A | mo17 | G | b73 | | | | |
| 327 | Ampli-con724279 | 82457 | 282 | 282 | SNP | C | b73 | T | mo17 | | | | |
| 327 | Ampli-con724279 | 82458 | 384 | 384 | SNP | G | mo17 | G | b73 | | | | |
| 327 | Ampli-con724279 | 82460 | 474 | 474 | SNP | A | b73 | T | mo17 | | | | |
| 327 | Ampli-con724279 | 82461 | 481 | 481 | SNP | G | mo17 | T | b73 | | | | |
| 327 | Ampli-con724279 | 82462 | 525 | 525 | SNP | A | mo17 | T | b73 | | | | |
| 327 | Ampli-con724279 | 82463 | 541 | 541 | SNP | G | b73 | G | mo17 | | | | |
| 328 | Ampli-con724510 | 83776 | 319 | 319 | SNP | A | b73 | T | mo17 | | | | |
| 328 | Ampli-con724510 | 83777 | 336 | 336 | SNP | C | b73 | T | mo17 | | | | |
| 328 | Ampli-con724510 | 83778 | 371 | 371 | SNP | C | mo17 | T | b73 | | | | |
| 328 | Ampli-con724510 | 83779 | 374 | 374 | SNP | G | mo17 | T | b73 | | | | |
| 328 | Ampli-con724510 | 83780 | 398 | 398 | SNP | G | mo17 | T | b73 | | | | |
| 329 | Ampli-con724623 | 84517 | 231 | 231 | SNP | A | mo17 | G | b73 | | | | |
| 329 | Ampli-con724623 | 84521 | 299 | 299 | SNP | G | mo17 | T | b73 | | | | |
| 329 | Ampli-con724623 | 84527 | 546 | 546 | SNP | A | mo17 | C | b73 | | | | |
| 329 | Ampli-con724623 | 84529 | 556 | 556 | SNP | C | mo17 | G | b73 | | | | |
| 329 | Ampli-con724623 | 84530 | 565 | 566 | IND | ** | mo17 | TG | b73 | | | | |
| 330 | Ampli-con740235 | 84829 | 505 | 505 | SNP | A | b73 | C | mo17 | | | | |
| 331 | Ampli-con993221 | 104389 | 210 | 210 | SNP | C | LH82 | T | 5CM1 | | | | |
| 331 | Ampli-con993221 | 104390 | 224 | 224 | SNP | C | LH82 | G | 5CM1 | | | | |
| 331 | Ampli-con993221 | 104391 | 225 | 225 | SNP | A | LH82 | G | 5CM1 | | | | |
| 331 | Ampli-con993221 | 104392 | 226 | 226 | SNP | C | 5CM1 | T | LH82 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 331 | Amplicon993221 | 104393 | 230 | 230 | SNP | C | 5CM1 | T | LH82 | | | | |
| 331 | Amplicon993221 | 104394 | 232 | 232 | SNP | A | 5CM1 | G | LH82 | | | | |
| 331 | Amplicon993221 | 104395 | 251 | 251 | SNP | C | LH82 | G | 5CM1 | | | | |
| 332 | Amplicon993232 | 104447 | 306 | 306 | SNP | A | LH82 | C | 5CM1 | | | | |
| 333 | Amplicon993240 | 104473 | 221 | 221 | SNP | A | 5CM1 | C | LH82 | | | | |
| 333 | Amplicon993240 | 104474 | 260 | 260 | SNP | C | 5CM1 | T | LH82 | | | | |
| 333 | Amplicon993240 | 104475 | 305 | 305 | SNP | A | 5CM1 | C | LH82 | | | | |
| 333 | Amplicon993240 | 104476 | 316 | 316 | SNP | A | LH82 | G | 5CM1 | | | | |
| 334 | Amplicon993248 | 104509 | 287 | 293 | IND | ******* | LH82 | CCAACAA | 5CM1 | | | | |
| 334 | Amplicon993248 | 104510 | 365 | 365 | SNP | C | LH82 | G | 5CM1 | | | | |
| 335 | Amplicon993299 | 104672 | 124 | 124 | SNP | A | LH82 | C | 5CM1 | | | | |
| 336 | Amplicon993328 | 104809 | 22 | 22 | SNP | C | LH82 | T | 5CM1 | | | | |
| 336 | Amplicon993328 | 104810 | 23 | 23 | SNP | G | 5CM1 | T | LH82 | | | | |
| 336 | Amplicon993328 | 104811 | 24 | 24 | SNP | A | 5CM1 | G | LH82 | | | | |
| 336 | Amplicon993328 | 104812 | 25 | 25 | SNP | C | LH82 | T | 5CM1 | | | | |
| 336 | Amplicon993328 | 104813 | 26 | 26 | SNP | C | LH82 | T | 5CM1 | | | | |
| 336 | Amplicon993328 | 104814 | 27 | 27 | SNP | A | LH82 | C | 5CM1 | | | | |
| 336 | Amplicon993328 | 104815 | 28 | 28 | SNP | C | 5CM1 | G | LH82 | | | | |
| 336 | Amplicon993328 | 104816 | 29 | 29 | SNP | A | LH82 | G | 5CM1 | | | | |
| 336 | Amplicon993328 | 104817 | 30 | 30 | SNP | A | 5CM1 | G | LH82 | | | | |
| 336 | Amplicon993328 | 104818 | 31 | 31 | SNP | A | LH82 | T | 5CM1 | | | | |
| 336 | Amplicon993328 | 104819 | 33 | 33 | SNP | A | 5CM1 | C | LH82 | | | | |
| 336 | Amplicon993328 | 104820 | 34 | 34 | SNP | A | LH82 | C | 5CM1 | | | | |
| 336 | Amplicon993328 | 104821 | 35 | 35 | SNP | A | 5CM1 | T | LH82 | | | | |
| 336 | Amplicon993328 | 104822 | 45 | 45 | SNP | A | 5CM1 | C | LH82 | | | | |
| 336 | Amplicon993328 | 104823 | 96 | 96 | SNP | A | LH82 | C | 5CM1 | | | | |
| 336 | Amplicon993328 | 104824 | 97 | 99 | IND | *** | 5CM1 | AAA | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 336 | Ampli-con993328 | 104825 | 183 | 183 | SNP | C | LH82 | T | 5CM1 | | | | |
| 336 | Ampli-con993328 | 104826 | 212 | 212 | SNP | C | 5CM1 | T | LH82 | | | | |
| 336 | Ampli-con993328 | 104827 | 275 | 275 | SNP | A | 5CM1 | G | LH82 | | | | |
| 336 | Ampli-con993328 | 104828 | 474 | 474 | SNP | C | 5CM1 | T | LH82 | | | | |
| 337 | Ampli-con993333 | 104845 | 32 | 32 | SNP | A | 5CM1 | G | LH82 | | | | |
| 337 | Ampli-con993333 | 104846 | 40 | 40 | SNP | C | 5CM1 | T | LH82 | | | | |
| 337 | Ampli-con993333 | 104847 | 141 | 141 | SNP | A | 5CM1 | T | 5CM1 | | | | |
| 337 | Ampli-con993333 | 104848 | 323 | 323 | SNP | A | LH82 | C | 5CM1 | | | | |
| 337 | Ampli-con993333 | 104849 | 365 | 365 | SNP | G | LH82 | T | LH82 | | | | |
| 337 | Ampli-con993333 | 104850 | 399 | 399 | SNP | A | 5CM1 | C | LH82 | | | | |
| 337 | Ampli-con993333 | 104851 | 431 | 431 | SNP | G | LH82 | T | 5CM1 | | | | |
| 337 | Ampli-con993333 | 104852 | 434 | 434 | SNP | C | 5CM1 | T | LH82 | | | | |
| 337 | Ampli-con993333 | 104853 | 455 | 455 | SNP | A | LH82 | T | 5CM1 | | | | |
| 337 | Ampli-con993333 | 104854 | 456 | 456 | SNP | A | LH82 | T | 5CM1 | | | | |
| 337 | Ampli-con993333 | 104855 | 460 | 460 | IND | * | LH82 | C | 5CM1 | | | | |
| 338 | Ampli-con993333 | 104857 | 84 | 84 | SNP | C | LH82 | T | 5CM1 | | | | |
| 338 | Ampli-con993334 | 104858 | 172 | 174 | IND | *** | LH82 | GCT | 5CM1 | | | | |
| 338 | Ampli-con993334 | 104859 | 209 | 209 | SNP | C | LH82 | T | 5CM1 | | | | |
| 338 | Ampli-con993334 | 104860 | 417 | 417 | SNP | C | LH82 | G | 5CM1 | | | | |
| 339 | Ampli-con993334 | 104861 | 224 | 224 | SNP | G | 5CM1 | T | LH82 | | | | |
| 339 | Ampli-con993335 | 104862 | 320 | 320 | SNP | C | LH82 | T | 5CM1 | | | | |
| 340 | Ampli-con993348 | 104939 | 36 | 36 | SNP | A | LH82 | G | 5CM1 | | | | |
| 340 | Ampli-con993348 | 104940 | 46 | 46 | SNP | C | 5CM1 | T | LH82 | | | | |
| 340 | Ampli-con993348 | 104941 | 53 | 53 | SNP | C | LH82 | G | 5CM1 | | | | |
| 340 | Ampli-con993348 | 104942 | 60 | 60 | SNP | A | 5CM1 | G | LH82 | | | | |
| 340 | Ampli-con993348 | 104943 | 64 | 64 | SNP | A | 5CM1 | G | LH82 | | | | |
| 340 | Ampli-con993348 | 104944 | 81 | 90 | IND | ********** | 5CM1 | CATTTTCAGT | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 340 | Ampli-con993348 | 104945 | 111 | 111 | SNP | G | 5CM1 | T | LH82 | | | | |
| 340 | Ampli-con993348 | 104946 | 268 | 268 | SNP | A | 5CM1 | T | LH82 | | | | |
| 340 | Ampli-con993348 | 104947 | 273 | 273 | SNP | A | LH82 | G | 5CM1 | | | | |
| 340 | Ampli-con993348 | 104948 | 295 | 295 | SNP | C | LH82 | T | 5CM1 | | | | |
| 340 | Ampli-con993348 | 104949 | 394 | 394 | SNP | A | LH82 | G | 5CM1 | | | | |
| 341 | Ampli-con993350 | 104950 | 76 | 76 | SNP | A | 5CM1 | G | LH82 | | | | |
| 341 | Ampli-con993350 | 104951 | 126 | 126 | SNP | G | 5CM1 | T | LH82 | | | | |
| 341 | Ampli-con993350 | 104952 | 162 | 162 | SNP | A | LH82 | T | 5CM1 | | | | |
| 341 | Ampli-con993350 | 104953 | 314 | 314 | SNP | A | 5CM1 | G | LH82 | | | | |
| 341 | Ampli-con993350 | 104954 | 375 | 375 | SNP | G | 5CM1 | T | LH82 | | | | |
| 342 | Ampli-con993378 | 105008 | 68 | 71 | IND | **** | LH82 | GTGC | 5CM1 | | | | |
| 342 | Ampli-con993378 | 105009 | 97 | 97 | SNP | A | 5CM1 | G | LH82 | | | | |
| 342 | Ampli-con993378 | 105010 | 113 | 113 | SNP | A | 5CM1 | G | LH82 | | | | |
| 342 | Ampli-con993378 | 105011 | 116 | 116 | SNP | C | LH82 | T | 5CM1 | | | | |
| 342 | Ampli-con993378 | 105012 | 270 | 270 | SNP | A | 5CM1 | G | LH82 | | | | |
| 342 | Ampli-con993378 | 105013 | 273 | 273 | SNP | C | 5CM1 | T | LH82 | | | | |
| 342 | Ampli-con993378 | 105014 | 347 | 347 | SNP | C | 5CM1 | G | LH82 | | | | |
| 342 | Ampli-con993378 | 105015 | 428 | 428 | SNP | C | LH82 | T | 5CM1 | | | | |
| 342 | Ampli-con993378 | 105016 | 430 | 430 | SNP | C | 5CM1 | G | LH82 | | | | |
| 342 | Ampli-con993378 | 105017 | 436 | 436 | SNP | A | 5CM1 | T | LH82 | | | | |
| 342 | Ampli-con993378 | 105018 | 438 | 438 | SNP | C | LH82 | T | 5CM1 | | | | |
| 342 | Ampli-con993378 | 105019 | 439 | 439 | SNP | G | LH82 | T | 5CM1 | | | | |
| 343 | Ampli-con993485 | 105546 | 103 | 105 | IND | *** | 5CM1 | AGC | LH82 | | | | |
| 343 | Ampli-con993485 | 105547 | 163 | 168 | IND | ****** | LH82 | GACTGC | 5CM1 | | | | |
| 343 | Ampli-con993485 | 105548 | 221 | 221 | SNP | A | 5CM1 | C | LH82 | | | | |
| 343 | Ampli-con993485 | 105549 | 229 | 229 | SNP | C | LH82 | G | 5CM1 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 344 | Ampli-con993496 | 105584 | 79 | 80 | IND | ** | 5CM1 | CT | LH82 | | | | |
| 344 | Ampli-con993496 | 105586 | 173 | 173 | SNP | C | 5CM1 | G | LH82 | | | | |
| 344 | Ampli-con993496 | 105587 | 376 | 376 | SNP | A | 5CM1 | G | LH82 | | | | |
| 344 | Ampli-con993496 | 105588 | 382 | 382 | SNP | G | 5CM1 | T | LH82 | | | | |
| 344 | Ampli-con993496 | 105589 | 469 | 469 | SNP | A | 5CM1 | T | LH82 | | | | |
| 344 | Ampli-con993496 | 105590 | 474 | 474 | SNP | C | LH82 | T | 5CM1 | | | | |
| 344 | Ampli-con993496 | 105591 | 477 | 477 | SNP | G | 5CM1 | T | 5CM1 | | | | |
| 344 | Ampli-con993496 | 105592 | 523 | 523 | SNP | C | LH82 | T | 5CM1 | | | | |
| 344 | Ampli-con993496 | 105593 | 536 | 538 | IND | *** | LH82 | CGT | 5CM1 | | | | |
| 345 | Ampli-con993496 | 105613 | 177 | 177 | SNP | C | 5CM1 | G | LH82 | | | | |
| 346 | Ampli-con993505 | 105647 | 198 | 198 | SNP | G | 5CM1 | T | 5CM1 | | | | |
| 346 | Ampli-con993513 | 105648 | 275 | 275 | SNP | C | LH82 | T | 5CM1 | | | | |
| 347 | Ampli-con993513 | 105854 | 346 | 346 | SNP | A | 5CM1 | G | LH82 | | | | |
| 347 | Ampli-con993561 | 105855 | 481 | 481 | SNP | A | 5CM1 | C | LH82 | | | | |
| 348 | Ampli-con993561 | 106239 | 72 | 72 | SNP | C | LH82 | T | 5CM1 | | | | |
| 348 | Ampli-con993642 | 106240 | 117 | 117 | IND | * | 5CM1 | T | LH82 | | | | |
| 348 | Ampli-con993642 | 106241 | 142 | 142 | SNP | A | LH82 | G | 5CM1 | | | | |
| 348 | Ampli-con993642 | 106242 | 153 | 154 | IND | ** | 5CM1 | TT | LH82 | | | | |
| 348 | Ampli-con993642 | 106243 | 206 | 206 | SNP | G | 5CM1 | T | LH82 | | | | |
| 348 | Ampli-con993642 | 106244 | 311 | 311 | SNP | A | 5CM1 | G | LH82 | | | | |
| 348 | Ampli-con993642 | 106245 | 361 | 361 | SNP | C | 5CM1 | T | 5CM1 | | | | |
| 349 | Ampli-con993642 | 106297 | 237 | 238 | IND | ** | LH82 | GT | 5CM1 | | | | |
| 349 | Ampli-con993659 | 106298 | 292 | 296 | IND | ***** | LH82 | ATAAT | 5CM1 | | | | |
| 349 | Ampli-con993659 | 106299 | 310 | 310 | SNP | G | 5CM1 | T | LH82 | | | | |
| 349 | Ampli-con993659 | 106300 | 328 | 329 | IND | ** | 5CM1 | CT | LH82 | | | | |
| 349 | Ampli-con993659 | 106301 | 420 | 420 | SNP | C | LH82 | T | 5CM1 | | | | |
| 349 | Ampli-con993659 | 106302 | 424 | 424 | SNP | A | 5CM1 | G | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 349 | Ampli-con993659 | 106303 | 432 | 434 | IND | *** | LH82 | CGG | 5CM1 | | | | |
| 349 | Ampli-con993659 | 106304 | 455 | 455 | SNP | G | LH82 | T | 5CM1 | | | | |
| 350 | Ampli-con993704 | 106482 | 38 | 38 | SNP | A | 5CM1 | C | LH82 | | | | |
| 350 | Ampli-con993704 | 106483 | 80 | 80 | IND | * | LH82 | A | 5CM1 | | | | |
| 350 | Ampli-con993704 | 106484 | 89 | 89 | SNP | A | 5CM1 | C | LH82 | | | | |
| 350 | Ampli-con993704 | 106485 | 91 | 91 | SNP | C | LH82 | T | 5CM1 | | | | |
| 350 | Ampli-con993704 | 106486 | 109 | 109 | SNP | A | 5CM1 | G | LH82 | | | | |
| 350 | Ampli-con993704 | 106487 | 126 | 126 | SNP | A | 5CM1 | G | LH82 | | | | |
| 350 | Ampli-con993704 | 106488 | 235 | 235 | SNP | C | 5CM1 | G | LH82 | | | | |
| 350 | Ampli-con993704 | 106489 | 354 | 354 | SNP | A | 5CM1 | G | LH82 | | | | |
| 350 | Ampli-con993704 | 106490 | 387 | 387 | SNP | A | 5CM1 | G | LH82 | | | | |
| 350 | Ampli-con993704 | 106491 | 393 | 393 | SNP | C | LH82 | T | 5CM1 | | | | |
| 351 | Ampli-con993739 | 106669 | 152 | 152 | SNP | C | 5CM1 | T | LH82 | | | | |
| 351 | Ampli-con993739 | 106670 | 172 | 172 | SNP | C | LH82 | G | 5CM1 | | | | |
| 351 | Ampli-con993739 | 106671 | 182 | 182 | SNP | A | 5CM1 | T | LH82 | | | | |
| 351 | Ampli-con993739 | 106672 | 183 | 183 | SNP | A | 5CM1 | C | LH82 | | | | |
| 351 | Ampli-con993739 | 106673 | 216 | 219 | IND | **** | LH82 | TATA | 5CM1 | | | | |
| 351 | Ampli-con993739 | 106674 | 235 | 236 | IND | ** | 5CM1 | CT | LH82 | | | | |
| 351 | Ampli-con993739 | 106675 | 241 | 244 | IND | **** | 5CM1 | CTAT | LH82 | | | | |
| 351 | Ampli-con993739 | 106676 | 247 | 247 | SNP | A | LH82 | G | 5CM1 | | | | |
| 351 | Ampli-con993739 | 106677 | 262 | 263 | IND | ** | LH82 | AC | 5CM1 | | | | |
| 351 | Ampli-con993739 | 106678 | 308 | 308 | SNP | C | LH82 | G | 5CM1 | | | | |
| 351 | Ampli-con993739 | 106679 | 319 | 319 | SNP | C | 5CM1 | T | LH82 | | | | |
| 351 | Ampli-con993739 | 106680 | 325 | 325 | SNP | C | 5CM1 | T | LH82 | | | | |
| 351 | Ampli-con993739 | 106681 | 355 | 355 | SNP | C | 5CM1 | T | LH82 | | | | |
| 352 | Ampli-con993761 | 106742 | 107 | 107 | SNP | A | 5CM1 | G | LH82 | | | | |
| 352 | Ampli-con993761 | 106743 | 234 | 234 | SNP | A | 5CM1 | G | LH82 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 352 | Ampli-con993761 | 106744 | 273 | 273 | SNP | A | 5CM1 | G | LH82 | | | | |
| 352 | Ampli-con993761 | 106745 | 501 | 501 | SNP | C | 5CM1 | T | LH82 | | | | |
| 353 | Ampli-con993787 | 106842 | 388 | 388 | SNP | A | 5CM1 | G | LH82 | | | | |
| 354 | Ampli-con993789 | 106844 | 81 | 81 | SNP | A | 5CM1 | G | LH82 | | | | |
| 354 | Ampli-con993789 | 106845 | 109 | 109 | SNP | A | LH82 | G | 5CM1 | | | | |
| 355 | Ampli-con993806 | 106912 | 182 | 182 | SNP | C | LH82 | G | 5CM1 | | | | |
| 356 | Ampli-con993827 | 107061 | 238 | 244 | IND | ******* | 5CM1 | GTATGAA | LH82 | | | | |
| 357 | Ampli-con993841 | 107074 | 180 | 180 | SNP | C | 5CM1 | T | LH82 | | | | |
| 357 | Ampli-con993841 | 107075 | 194 | 194 | SNP | C | 5CM1 | T | LH82 | | | | |
| 357 | Ampli-con993841 | 107076 | 205 | 205 | SNP | C | LH82 | T | 5CM1 | | | | |
| 357 | Ampli-con993841 | 107077 | 380 | 380 | SNP | A | LH82 | G | 5CM1 | | | | |
| 357 | Ampli-con993841 | 107078 | 431 | 431 | SNP | C | LH82 | T | 5CM1 | | | | |
| 358 | Ampli-con993884 | 107274 | 79 | 79 | SNP | C | 5CM1 | G | LH82 | | | | |
| 358 | Ampli-con993884 | 107275 | 289 | 289 | SNP | C | 5CM1 | T | LH82 | | | | |
| 358 | Ampli-con993884 | 107276 | 401 | 401 | SNP | A | LH82 | G | 5CM1 | | | | |
| 358 | Ampli-con993884 | 107277 | 486 | 486 | IND | * | LH82 | G | 5CM1 | | | | |
| 358 | Ampli-con993884 | 107278 | 487 | 489 | IND | *** | 5CM1 | GTG | LH82 | | | | |
| 359 | Ampli-con993886 | 107279 | 159 | 159 | SNP | A | 5CM1 | G | LH82 | | | | |
| 359 | Ampli-con993886 | 107280 | 165 | 165 | SNP | A | LH82 | G | 5CM1 | | | | |
| 359 | Ampli-con993886 | 107285 | 211 | 211 | SNP | A | LH82 | G | 5CM1 | | | | |
| 359 | Ampli-con993886 | 107286 | 256 | 256 | SNP | C | LH82 | T | 5CM1 | | | | |
| 360 | Ampli-con993907 | 107396 | 74 | 76 | IND | *** | LH82 | AGC | 5CM1 | | | | |
| 360 | Ampli-con993907 | 107397 | 90 | 90 | SNP | C | LH82 | G | 5CM1 | | | | |
| 360 | Ampli-con993907 | 107398 | 213 | 213 | SNP | A | 5CM1 | T | LH82 | | | | |
| 361 | Ampli-con993920 | 107449 | 284 | 284 | SNP | C | LH82 | T | 5CM1 | | | | |
| 362 | Ampli-con993953 | 107617 | 110 | 110 | SNP | C | 5CM1 | T | LH82 | | | | |
| 362 | Ampli-con993953 | 107618 | 125 | 125 | SNP | C | LH82 | T | 5CM1 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 362 | Amplicon993953 | 107619 | 127 | 127 | SNP | G | 5CM1 | T | LH82 | | | | |
| 362 | Amplicon993953 | 107620 | 347 | 347 | SNP | A | 5CM1 | G | LH82 | | | | |
| 362 | Amplicon993953 | 107621 | 365 | 371 | IND | ******** | LH82 | GTTACAA | 5CM1 | | | | |
| 363 | Amplicon993958 | 107639 | 206 | 206 | SNP | A | 5CM1 | T | LH82 | | | | |
| 364 | Amplicon993973 | 107693 | 86 | 86 | SNP | C | LH82 | T | 5CM1 | | | | |
| 364 | Amplicon993973 | 107694 | 155 | 155 | SNP | C | 5CM1 | T | LH82 | | | | |
| 364 | Amplicon993973 | 107695 | 160 | 160 | SNP | A | LH82 | G | 5CM1 | | | | |
| 364 | Amplicon993973 | 107696 | 180 | 188 | IND | ********** | LH82 | AAATTTGGT | 5CM1 | | | | |
| 364 | Amplicon993973 | 107697 | 212 | 212 | SNP | A | 5CM1 | G | LH82 | | | | |
| 364 | Amplicon993973 | 107698 | 293 | 293 | SNP | C | LH82 | T | 5CM1 | | | | |
| 364 | Amplicon993973 | 107699 | 336 | 336 | SNP | A | LH82 | G | 5CM1 | | | | |
| 364 | Amplicon993973 | 107700 | 372 | 372 | SNP | A | LH82 | G | 5CM1 | | | | |
| 364 | Amplicon993973 | 107701 | 376 | 376 | SNP | A | 5CM1 | G | LH82 | | | | |
| 364 | Amplicon993973 | 107702 | 441 | 441 | IND | * | LH82 | A | 5CM1 | | | | |
| 365 | Amplicon994009 | 107784 | 96 | 96 | SNP | G | LH82 | T | 5CM1 | | | | |
| 365 | Amplicon994009 | 107785 | 117 | 117 | SNP | C | 5CM1 | G | LH82 | | | | |
| 365 | Amplicon994009 | 107786 | 166 | 166 | SNP | A | LH82 | G | 5CM1 | | | | |
| 365 | Amplicon994009 | 107787 | 174 | 174 | SNP | A | 5CM1 | C | LH82 | | | | |
| 365 | Amplicon994009 | 107788 | 537 | 537 | SNP | A | LH82 | T | 5CM1 | | | | |
| 366 | Amplicon994012 | 107839 | 34 | 34 | IND | * | LH82 | T | 5CM1 | | | | |
| 366 | Amplicon994012 | 107840 | 153 | 153 | SNP | C | 5CM1 | G | LH82 | | | | |
| 366 | Amplicon994012 | 107841 | 211 | 211 | SNP | A | LH82 | C | 5CM1 | | | | |
| 366 | Amplicon994012 | 107842 | 220 | 220 | SNP | A | 5CM1 | G | LH82 | | | | |
| 366 | Amplicon994012 | 107844 | 423 | 431 | IND | ********** | 5CM1 | TATTTTCGT | LH82 | | | | |
| 366 | Amplicon994012 | 107845 | 447 | 447 | SNP | G | LH82 | T | 5CM1 | | | | |
| 367 | Amplicon994024 | 107857 | 186 | 188 | IND | *** | LH82 | TAA | 5CM1 | | | | |
| 367 | Amplicon994024 | 107858 | 400 | 400 | SNP | C | 5CM1 | T | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 367 | Ampli-con994024 | 107859 | 448 | 448 | IND | * | LH82 | A | 5CM1 | | | | |
| 367 | Ampli-con994024 | 107860 | 474 | 474 | SNP | C | 5CM1 | T | LH82 | | | | |
| 367 | Ampli-con994024 | 107861 | 478 | 478 | SNP | A | LH82 | G | 5CM1 | | | | |
| 368 | Ampli-con994036 | 107908 | 92 | 92 | SNP | G | 5CM1 | T | LH82 | | | | |
| 368 | Ampli-con994036 | 107909 | 151 | 151 | SNP | A | 5CM1 | G | LH82 | | | | |
| 368 | Ampli-con994036 | 107910 | 319 | 319 | SNP | A | 5CM1 | T | LH82 | | | | |
| 368 | Ampli-con994036 | 107911 | 384 | 384 | SNP | G | LH82 | T | 5CM1 | | | | |
| 368 | Ampli-con994036 | 107912 | 442 | 442 | SNP | C | LH82 | T | 5CM1 | | | | |
| 368 | Ampli-con994036 | 107913 | 473 | 473 | SNP | C | LH82 | T | 5CM1 | | | | |
| 369 | Ampli-con994045 | 107937 | 310 | 310 | SNP | A | 5CM1 | G | LH82 | | | | |
| 369 | Ampli-con994045 | 107938 | 331 | 331 | SNP | A | LH82 | T | 5CM1 | | | | |
| 369 | Ampli-con994045 | 107939 | 339 | 339 | SNP | G | LH82 | T | 5CM1 | | | | |
| 369 | Ampli-con994045 | 107940 | 415 | 415 | SNP | A | 5CM1 | C | LH82 | | | | |
| 370 | Ampli-con994047 | 107941 | 365 | 365 | SNP | A | LH82 | G | 5CM1 | | | | |
| 371 | Ampli-con994062 | 108008 | 100 | 100 | SNP | A | LH82 | G | 5CM1 | | | | |
| 371 | Ampli-con994062 | 108009 | 133 | 133 | SNP | C | LH82 | G | 5CM1 | | | | |
| 371 | Ampli-con994062 | 108010 | 153 | 153 | IND | * | LH82 | T | 5CM1 | | | | |
| 371 | Ampli-con994062 | 108011 | 176 | 176 | SNP | C | 5CM1 | T | LH82 | | | | |
| 372 | Ampli-con994062 | 108012 | 233 | 233 | SNP | C | 5CM1 | T | LH82 | | | | |
| 372 | Ampli-con994062 | 108013 | 339 | 339 | SNP | C | 5CM1 | T | LH82 | | | | |
| 372 | Ampli-con994062 | 108211 | 235 | 235 | SNP | A | 5CM1 | G | LH82 | | | | |
| 372 | Ampli-con994124 | 108212 | 336 | 337 | IND | ** | LH82 | GA | 5CM1 | | | | |
| 373 | Ampli-con994124 | 108432 | 59 | 59 | SNP | C | LH82 | T | 5CM1 | | | | |
| 373 | Ampli-con1017005 | 108433 | 227 | 227 | SNP | C | 5CM1 | T | LH82 | | | | |
| 373 | Ampli-con1017005 | 108434 | 240 | 240 | SNP | A | 5CM1 | G | LH82 | | | | |
| 373 | Ampli-con1017005 | 108435 | 268 | 268 | SNP | G | 5CM1 | T | LH82 | | | | |
| 373 | Ampli-con1017005 | 108436 | 382 | 382 | SNP | C | 5CM1 | T | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 373 | Ampli-con1017005 | 108437 | 479 | 479 | SNP | A | LH82 | G | 5CM1 | | | | |
| 373 | Ampli-con1017005 | 108438 | 502 | 502 | SNP | A | 5CM1 | G | LH82 | | | | |
| 373 | Ampli-con1017005 | 108439 | 513 | 513 | SNP | A | 5CM1 | T | LH82 | | | | |
| 373 | Ampli-con1017005 | 108440 | 514 | 514 | SNP | A | 5CM1 | G | LH82 | | | | |
| 373 | Ampli-con1017005 | 108441 | 515 | 515 | SNP | A | LH82 | T | 5CM1 | | | | |
| 373 | Ampli-con1017005 | 108442 | 516 | 516 | SNP | G | LH82 | T | 5CM1 | | | | |
| 373 | Ampli-con1017005 | 108443 | 518 | 518 | SNP | A | LH82 | T | 5CM1 | | | | |
| 373 | Ampli-con1017005 | 108444 | 519 | 519 | SNP | C | LH82 | T | 5CM1 | | | | |
| 373 | Ampli-con1017005 | 108445 | 520 | 520 | SNP | A | LH82 | C | 5CM1 | | | | |
| 373 | Ampli-con1017005 | 108446 | 521 | 521 | SNP | C | 5CM1 | G | LH82 | | | | |
| 373 | Ampli-con1017005 | 108447 | 522 | 522 | SNP | C | LH82 | T | 5CM1 | | | | |
| 373 | Ampli-con1017005 | 108448 | 523 | 523 | SNP | A | LH82 | T | 5CM1 | | | | |
| 373 | Ampli-con1017005 | 108449 | 524 | 524 | SNP | C | LH82 | G | 5CM1 | | | | |
| 373 | Ampli-con1017005 | 108450 | 525 | 525 | SNP | C | LH82 | T | 5CM1 | | | | |
| 373 | Ampli-con1017005 | 108451 | 526 | 526 | SNP | A | LH82 | T | 5CM1 | | | | |
| 373 | Ampli-con1017005 | 108452 | 527 | 527 | SNP | A | 5CM1 | C | LH82 | | | | |
| 373 | Ampli-con1017005 | 108453 | 530 | 530 | SNP | C | 5CM1 | T | LH82 | | | | |
| 373 | Ampli-con1017005 | 108454 | 531 | 531 | SNP | A | LH82 | T | 5CM1 | | | | |
| 373 | Ampli-con1017005 | 108455 | 532 | 532 | SNP | A | LH82 | T | 5CM1 | | | | |
| 373 | Ampli-con1017005 | 108456 | 533 | 533 | SNP | A | LH82 | T | 5CM1 | | | | |
| 373 | Ampli-con1017005 | 108457 | 534 | 534 | SNP | G | 5CM1 | G | LH82 | | | | |
| 373 | Ampli-con1017005 | 108458 | 535 | 535 | SNP | G | LH82 | T | 5CM1 | | | | |
| 373 | Ampli-con1017005 | 108459 | 536 | 536 | SNP | G | LH82 | T | 5CM1 | | | | |
| 373 | Ampli-con1017005 | 108460 | 538 | 538 | SNP | A | LH82 | T | 5CM1 | | | | |
| 373 | Ampli-con1017005 | 108461 | 539 | 539 | SNP | C | LH82 | T | 5CM1 | | | | |
| 373 | Ampli-con1017005 | 108462 | 540 | 540 | SNP | G | LH82 | T | 5CM1 | | | | |
| 373 | Ampli-con1017005 | 108463 | 541 | 541 | SNP | A | LH82 | T | 5CM1 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 373 | Ampli-con1017005 | 108464 | 542 | 542 | SNP | A | LH82 | T | 5CM1 | | | | |
| 373 | Ampli-con1017005 | 108465 | 544 | 544 | SNP | G | 5CM1 | T | LH82 | | | | |
| 373 | Ampli-con1017005 | 108466 | 546 | 546 | SNP | A | LH82 | T | 5CM1 | | | | |
| 373 | Ampli-con1017005 | 108467 | 547 | 547 | SNP | A | LH82 | T | 5CM1 | | | | |
| 373 | Ampli-con1017005 | 108468 | 549 | 549 | SNP | A | LH82 | T | 5CM1 | | | | |
| 373 | Ampli-con1017005 | 108469 | 551 | 551 | SNP | A | 5CM1 | C | LH82 | | | | |
| 373 | Ampli-con1017005 | 108470 | 552 | 552 | SNP | A | 5CM1 | C | LH82 | | | | |
| 373 | Ampli-con1017005 | 108471 | 553 | 553 | SNP | A | 5CM1 | C | LH82 | | | | |
| 373 | Ampli-con1017005 | 108472 | 554 | 554 | SNP | G | 5CM1 | T | LH82 | | | | |
| 373 | Ampli-con1017005 | 108473 | 556 | 556 | SNP | A | LH82 | T | 5CM1 | | | | |
| 373 | Ampli-con1017005 | 108474 | 557 | 557 | SNP | A | LH82 | G | 5CM1 | | | | |
| 373 | Ampli-con1017005 | 108475 | 558 | 558 | SNP | A | LH82 | C | 5CM1 | | | | |
| 373 | Ampli-con1017005 | 108476 | 559 | 559 | SNP | A | LH82 | C | 5CM1 | | | | |
| 373 | Ampli-con1017005 | 108477 | 561 | 561 | SNP | A | LH82 | G | 5CM1 | | | | |
| 373 | Ampli-con1017005 | 108478 | 562 | 562 | SNP | A | 5CM1 | T | LH82 | | | | |
| 373 | Ampli-con1017005 | 108479 | 564 | 564 | SNP | A | 5CM1 | C | LH82 | | | | |
| 373 | Ampli-con1017005 | 108480 | 565 | 565 | SNP | A | 5CM1 | T | LH82 | | | | |
| 373 | Ampli-con1017005 | 108481 | 566 | 566 | SNP | A | LH82 | T | 5CM1 | | | | |
| 373 | Ampli-con1017005 | 108482 | 567 | 567 | SNP | A | 5CM1 | T | LH82 | | | | |
| 373 | Ampli-con1017005 | 108483 | 568 | 568 | SNP | A | 5CM1 | T | LH82 | | | | |
| 373 | Ampli-con1017005 | 108484 | 569 | 569 | SNP | C | 5CM1 | T | LH82 | | | | |
| 373 | Ampli-con1017005 | 108486 | 571 | 571 | SNP | C | 5CM1 | T | LH82 | | | | |
| 373 | Ampli-con1017005 | 108489 | 575 | 575 | SNP | C | 5CM1 | T | LH82 | | | | |
| 374 | Ampli-con1017007 | 108492 | 126 | 126 | SNP | A | LH82 | T | 5CM1 | | | | |
| 374 | Ampli-con1017007 | 108493 | 303 | 303 | SNP | G | LH82 | T | 5CM1 | | | | |
| 374 | Ampli-con1017007 | 108494 | 356 | 356 | SNP | C | LH82 | T | 5CM1 | | | | |
| 374 | Ampli-con1017007 | 108495 | 480 | 480 | SNP | C | LH82 | T | 5CM1 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 375 | Amplicon1017028 | 108630 | 340 | 340 | SNP | A | 5CM1 | G | LH82 | | | | |
| 376 | Amplicon1017085 | 108862 | 48 | 48 | SNP | C | LH82 | T | 5CM1 | | | | |
| 376 | Amplicon1017085 | 108863 | 111 | 111 | SNP | C | 5CM1 | G | LH82 | | | | |
| 376 | Amplicon1017085 | 108864 | 118 | 118 | SNP | A | 5CM1 | T | 5CM1 | | | | |
| 376 | Amplicon1017085 | 108865 | 188 | 188 | SNP | C | LH82 | G | 5CM1 | | | | |
| 376 | Amplicon1017085 | 108866 | 296 | 296 | SNP | A | LH82 | C | 5CM1 | | | | |
| 376 | Amplicon1017085 | 108867 | 298 | 298 | SNP | G | 5CM1 | T | LH82 | | | | |
| 376 | Amplicon1017085 | 108868 | 383 | 384 | IND | ** | LH82 | AC | 5CM1 | | | | |
| 376 | Amplicon1017085 | 108869 | 388 | 388 | SNP | A | 5CM1 | G | LH82 | | | | |
| 376 | Amplicon1017085 | 108870 | 411 | 411 | SNP | A | 5CM1 | G | LH82 | | | | |
| 376 | Amplicon1017085 | 108871 | 435 | 435 | SNP | A | 5CM1 | G | LH82 | | | | |
| 376 | Amplicon1017085 | 108872 | 440 | 440 | SNP | C | 5CM1 | T | LH82 | | | | |
| 376 | Amplicon1017085 | 108873 | 496 | 497 | IND | ** | LH82 | GA | 5CM1 | | | | |
| 376 | Amplicon1017085 | 108874 | 524 | 524 | SNP | C | LH82 | T | 5CM1 | | | | |
| 376 | Amplicon1017085 | 108875 | 582 | 582 | SNP | A | LH82 | T | LH82 | | | | |
| 377 | Amplicon1017165 | 109198 | 89 | 89 | SNP | A | LH82 | C | 5CM1 | | | | |
| 377 | Amplicon1017165 | 109199 | 90 | 90 | IND | * | LH82 | T | 5CM1 | | | | |
| 377 | Amplicon1017165 | 109200 | 94 | 95 | IND | ** | LH82 | CC | 5CM1 | | | | |
| 377 | Amplicon1017165 | 109201 | 97 | 97 | SNP | A | 5CM1 | G | LH82 | | | | |
| 377 | Amplicon1017165 | 109202 | 99 | 99 | SNP | C | LH82 | T | 5CM1 | | | | |
| 377 | Amplicon1017165 | 109203 | 100 | 100 | SNP | A | 5CM1 | C | LH82 | | | | |
| 377 | Amplicon1017165 | 109204 | 102 | 102 | SNP | C | 5CM1 | G | LH82 | | | | |
| 377 | Amplicon1017165 | 109205 | 106 | 106 | SNP | C | 5CM1 | G | LH82 | | | | |
| 377 | Amplicon1017165 | 109206 | 107 | 107 | SNP | A | LH82 | G | 5CM1 | | | | |
| 377 | Amplicon1017165 | 109207 | 150 | 150 | SNP | C | 5CM1 | T | LH82 | | | | |
| 377 | Amplicon1017165 | 109208 | 159 | 159 | SNP | A | 5CM1 | G | LH82 | | | | |
| 377 | Amplicon1017165 | 109209 | 272 | 272 | SNP | G | LH82 | T | 5CM1 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 377 | Ampli-con1017165 | 109210 | 299 | 299 | SNP | G | 5CM1 | T | LH82 | | | | |
| 377 | Ampli-con1017165 | 109211 | 303 | 303 | SNP | A | LH82 | G | 5CM1 | | | | |
| 377 | Ampli-con1017165 | 109212 | 477 | 477 | SNP | A | 5CM1 | C | LH82 | | | | |
| 377 | Ampli-con1017165 | 109213 | 478 | 478 | SNP | A | 5CM1 | G | LH82 | | | | |
| 377 | Ampli-con1017165 | 109214 | 479 | 479 | SNP | A | 5CM1 | G | LH82 | | | | |
| 377 | Ampli-con1017165 | 109215 | 506 | 506 | SNP | A | LH82 | G | 5CM1 | | | | |
| 377 | Ampli-con1017165 | 109216 | 530 | 530 | SNP | G | 5CM1 | T | LH82 | | | | |
| 377 | Ampli-con1017165 | 109217 | 548 | 548 | SNP | C | LH82 | T | 5CM1 | | | | |
| 377 | Ampli-con1017165 | 109218 | 575 | 575 | SNP | C | 5CM1 | G | LH82 | | | | |
| 377 | Ampli-con1017165 | 109219 | 581 | 581 | IND | * | 5CM1 | C | LH82 | | | | |
| 377 | Ampli-con1017165 | 109220 | 585 | 585 | IND | * | 5CM1 | C | LH82 | | | | |
| 377 | Ampli-con1017165 | 109221 | 593 | 593 | SNP | A | LH82 | C | 5CM1 | | | | |
| 377 | Ampli-con1017165 | 109222 | 595 | 595 | SNP | A | LH82 | C | 5CM1 | | | | |
| 378 | Ampli-con1017176 | 109306 | 27 | 27 | SNP | A | LH82 | C | 5CM1 | | | | |
| 378 | Ampli-con1017176 | 109307 | 70 | 70 | SNP | A | LH82 | G | 5CM1 | | | | |
| 378 | Ampli-con1017176 | 109308 | 72 | 72 | IND | * | 5CM1 | G | LH82 | | | | |
| 378 | Ampli-con1017176 | 109309 | 78 | 78 | IND | * | 5CM1 | T | LH82 | | | | |
| 378 | Ampli-con1017176 | 109310 | 80 | 80 | SNP | A | LH82 | G | 5CM1 | | | | |
| 378 | Ampli-con1017176 | 109311 | 127 | 127 | SNP | C | 5CM1 | T | LH82 | | | | |
| 378 | Ampli-con1017176 | 109312 | 145 | 145 | SNP | C | 5CM1 | T | LH82 | | | | |
| 378 | Ampli-con1017176 | 109313 | 175 | 176 | IND | ** | 5CM1 | AT | LH82 | | | | |
| 378 | Ampli-con1017176 | 109314 | 250 | 250 | SNP | G | LH82 | T | 5CM1 | | | | |
| 378 | Ampli-con1017176 | 109315 | 268 | 268 | SNP | C | LH82 | T | 5CM1 | | | | |
| 379 | Ampli-con1017183 | 109328 | 565 | 565 | SNP | A | LH82 | G | 5CM1 | | | | |
| 380 | Ampli-con1017186 | 109342 | 525 | 525 | SNP | A | LH82 | G | 5CM1 | | | | |
| 381 | Ampli-con1017193 | 109396 | 439 | 448 | IND | ********** | LH82 | ACACACAC | 5CM1 | | | | |
| 381 | Ampli-con1017193 | 109397 | 481 | 481 | SNP | C | LH82 | G | 5CM1 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 381 | Ampli-con1017193 | 109398 | 487 | 490 | IND | **** | LH82 | CTCA | 5CM1 | | | | |
| 381 | Ampli-con1017193 | 109399 | 495 | 495 | SNP | C | LH82 | G | 5CM1 | | | | |
| 381 | Ampli-con1017193 | 109400 | 499 | 499 | SNP | C | LH82 | G | 5CM1 | | | | |
| 381 | Ampli-con1017193 | 109401 | 503 | 503 | SNP | C | LH82 | G | 5CM1 | | | | |
| 381 | Ampli-con1017193 | 109402 | 510 | 510 | SNP | A | 5CM1 | G | LH82 | | | | |
| 381 | Ampli-con1017193 | 109403 | 522 | 524 | IND | *** | LH82 | TTC | 5CM1 | | | | |
| 381 | Ampli-con1017193 | 109404 | 539 | 539 | SNP | C | LH82 | G | 5CM1 | | | | |
| 382 | Ampli-con1017219 | 109508 | 47 | 47 | SNP | C | LH82 | T | 5CM1 | | | | |
| 382 | Ampli-con1017219 | 109509 | 53 | 53 | SNP | A | 5CM1 | G | LH82 | | | | |
| 382 | Ampli-con1017219 | 109510 | 155 | 155 | SNP | C | LH82 | T | 5CM1 | | | | |
| 382 | Ampli-con1017219 | 109511 | 179 | 179 | SNP | G | LH82 | T | 5CM1 | | | | |
| 382 | Ampli-con1017219 | 109512 | 187 | 187 | SNP | C | LH82 | G | 5CM1 | | | | |
| 382 | Ampli-con1017219 | 109513 | 204 | 204 | SNP | C | LH82 | G | 5CM1 | | | | |
| 382 | Ampli-con1017219 | 109514 | 206 | 208 | IND | *** | 5CM1 | CAC | LH82 | | | | |
| 382 | Ampli-con1017219 | 109516 | 214 | 218 | IND | ***** | 5CM1 | TTCCT | LH82 | | | | |
| 383 | Ampli-con1017256 | 109666 | 74 | 74 | SNP | C | LH82 | G | 5CM1 | | | | |
| 383 | Ampli-con1017256 | 109667 | 80 | 80 | SNP | A | 5CM1 | G | LH82 | | | | |
| 383 | Ampli-con1017256 | 109668 | 267 | 267 | SNP | A | 5CM1 | C | LH82 | | | | |
| 383 | Ampli-con1017256 | 109669 | 326 | 326 | SNP | A | 5CM1 | G | LH82 | | | | |
| 383 | Ampli-con1017256 | 109670 | 355 | 355 | SNP | C | LH82 | T | 5CM1 | | | | |
| 383 | Ampli-con1017256 | 109672 | 447 | 447 | SNP | C | 5CM1 | T | LH82 | | | | |
| 383 | Ampli-con1017256 | 109673 | 476 | 476 | IND | * | LH82 | A | 5CM1 | | | | |
| 383 | Ampli-con1017256 | 109674 | 477 | 478 | IND | ** | LH82 | GA | 5CM1 | | | | |
| 383 | Ampli-con1017256 | 109675 | 542 | 542 | SNP | A | 5CM1 | G | LH82 | | | | |
| 384 | Ampli-con1017272 | 109720 | 108 | 108 | SNP | A | LH82 | G | 5CM1 | | | | |
| 384 | Ampli-con1017272 | 109721 | 193 | 193 | SNP | A | LH82 | C | 5CM1 | | | | |
| 384 | Ampli-con1017272 | 109722 | 560 | 560 | SNP | A | 5CM1 | G | LH82 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 385 | Ampli-con1017287 | 109797 | 165 | 168 | IND | **** | LH82 | TACG | 5CM1 | | | | |
| 385 | Ampli-con1017287 | 109798 | 212 | 212 | SNP | A | LH82 | G | 5CM1 | | | | |
| 385 | Ampli-con1017287 | 109799 | 215 | 215 | SNP | A | LH82 | G | 5CM1 | | | | |
| 385 | Ampli-con1017287 | 109800 | 222 | 224 | IND | *** | LH82 | TCT | 5CM1 | | | | |
| 385 | Ampli-con1017287 | 109801 | 331 | 331 | SNP | A | 5CM1 | C | LH82 | | | | |
| 385 | Ampli-con1017287 | 109802 | 516 | 516 | SNP | C | 5CM1 | G | LH82 | | | | |
| 385 | Ampli-con1017287 | 109803 | 562 | 562 | SNP | C | 5CM1 | T | LH82 | | | | |
| 385 | Ampli-con1017287 | 109804 | 576 | 577 | IND | ** | LH82 | AG | 5CM1 | | | | |
| 385 | Ampli-con1017287 | 109805 | 642 | 642 | SNP | A | LH82 | G | 5CM1 | | | | |
| 386 | Ampli-con1017331 | 110063 | 16 | 16 | SNP | G | 5CM1 | T | LH82 | | | | |
| 386 | Ampli-con1017331 | 110064 | 20 | 20 | SNP | C | 5CM1 | G | LH82 | | | | |
| 386 | Ampli-con1017331 | 110065 | 122 | 122 | SNP | A | 5CM1 | G | LH82 | | | | |
| 386 | Ampli-con1017331 | 110066 | 244 | 247 | IND | **** | LH82 | TATA | 5CM1 | | | | |
| 386 | Ampli-con1017331 | 110067 | 275 | 275 | SNP | A | 5CM1 | G | LH82 | | | | |
| 386 | Ampli-con1017331 | 110068 | 280 | 280 | SNP | C | 5CM1 | G | LH82 | | | | |
| 386 | Ampli-con1017331 | 110069 | 313 | 313 | SNP | A | 5CM1 | G | LH82 | | | | |
| 386 | Ampli-con1017331 | 110070 | 374 | 374 | SNP | G | 5CM1 | T | LH82 | | | | |
| 387 | Ampli-con1017357 | 110147 | 244 | 244 | SNP | C | 5CM1 | T | LH82 | | | | |
| 387 | Ampli-con1017357 | 110148 | 253 | 253 | SNP | C | 5CM1 | T | LH82 | | | | |
| 387 | Ampli-con1017357 | 110149 | 285 | 285 | SNP | A | 5CM1 | G | LH82 | | | | |
| 387 | Ampli-con1017357 | 110150 | 380 | 386 | IND | ******* | 5CM1 | CAGGAAA | LH82 | | | | |
| 388 | Ampli-con1017357 | 110376 | 262 | 262 | SNP | A | 5CM1 | G | LH82 | | | | |
| 388 | Ampli-con1017409 | 110377 | 550 | 550 | SNP | C | LH82 | T | 5CM1 | | | | |
| 389 | Ampli-con1017409 | 110603 | 268 | 268 | SNP | C | 5CM1 | T | LH82 | | | | |
| 389 | Ampli-con1017456 | 110604 | 276 | 276 | IND | * | LH82 | G | 5CM1 | | | | |
| 389 | Ampli-con1017456 | 110605 | 303 | 303 | SNP | A | LH82 | G | 5CM1 | | | | |
| 389 | Ampli-con1017456 | 110606 | 446 | 446 | SNP | A | LH82 | C | 5CM1 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 389 | Ampli-con1017456 | 110607 | 483 | 483 | SNP | G | LH82 | T | 5CM1 | | | | |
| 389 | Ampli-con1017456 | 110608 | 528 | 528 | SNP | A | LH82 | G | 5CM1 | | | | |
| 390 | Ampli-con1017466 | 110684 | 269 | 269 | SNP | C | LH82 | T | 5CM1 | | | | |
| 390 | Ampli-con1017466 | 110685 | 475 | 475 | SNP | C | 5CM1 | T | LH82 | | | | |
| 391 | Ampli-con1017484 | 110769 | 431 | 433 | IND | *** | LH82 | ACT | 5CM1 | | | | |
| 391 | Ampli-con1017484 | 110770 | 434 | 434 | IND | * | LH82 | T | 5CM1 | | | | |
| 391 | Ampli-con1017484 | 110771 | 489 | 489 | SNP | C | LH82 | C | 5CM1 | | | | |
| 392 | Ampli-con1017493 | 110780 | 359 | 359 | SNP | A | LH82 | G | 5CM1 | | | | |
| 393 | Ampli-con1017498 | 110792 | 17 | 17 | SNP | A | LH82 | C | 5CM1 | | | | |
| 393 | Ampli-con1017498 | 110793 | 23 | 23 | SNP | G | LH82 | T | 5CM1 | | | | |
| 393 | Ampli-con1017498 | 110795 | 47 | 48 | IND | ** | LH82 | TA | 5CM1 | | | | |
| 393 | Ampli-con1017498 | 110796 | 117 | 117 | SNP | C | 5CM1 | T | LH82 | | | | |
| 393 | Ampli-con1017498 | 110797 | 170 | 170 | SNP | G | 5CM1 | T | LH82 | | | | |
| 393 | Ampli-con1017498 | 110798 | 248 | 248 | SNP | C | LH82 | T | 5CM1 | | | | |
| 393 | Ampli-con1017498 | 110799 | 282 | 282 | SNP | C | 5CM1 | G | LH82 | | | | |
| 393 | Ampli-con1017498 | 110800 | 405 | 405 | SNP | A | 5CM1 | G | LH82 | | | | |
| 393 | Ampli-con1017498 | 110801 | 411 | 411 | SNP | C | 5CM1 | T | LH82 | | | | |
| 393 | Ampli-con1017498 | 110802 | 412 | 412 | SNP | A | LH82 | C | 5CM1 | | | | |
| 393 | Ampli-con1017498 | 110803 | 567 | 567 | SNP | A | LH82 | G | 5CM1 | | | | |
| 394 | Ampli-con1017519 | 110886 | 93 | 98 | IND | ****** | LH82 | ATCTGC | 5CM1 | | | | |
| 394 | Ampli-con1017519 | 110887 | 135 | 135 | SNP | C | LH82 | T | 5CM1 | | | | |
| 394 | Ampli-con1017519 | 110888 | 261 | 264 | IND | **** | LH82 | TTAT | 5CM1 | | | | |
| 394 | Ampli-con1017519 | 110889 | 355 | 355 | SNP | G | LH82 | T | 5CM1 | | | | |
| 394 | Ampli-con1017519 | 110890 | 402 | 402 | IND | * | LH82 | T | 5CM1 | | | | |
| 394 | Ampli-con1017519 | 110891 | 404 | 408 | IND | ***** | LH82 | CCTGT | 5CM1 | | | | |
| 394 | Ampli-con1017519 | 110892 | 431 | 431 | SNP | A | 5CM1 | T | LH82 | | | | |
| 394 | Ampli-con1017519 | 110894 | 464 | 470 | IND | ******* | LH82 | GAACCAA | 5CM1 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 394 | Ampli-con1017519 | 110895 | 546 | 546 | SNP | C | 5CM1 | G | LH82 | | | | |
| 394 | Ampli-con1017519 | 110896 | 552 | 552 | IND | * | LH82 | A | 5CM1 | | | | |
| 394 | Ampli-con1017519 | 110897 | 554 | 556 | IND | *** | LH82 | CAT | 5CM1 | | | | |
| 395 | Ampli-con1017554 | 110972 | 53 | 53 | SNP | A | 5CM1 | G | LH82 | | | | |
| 395 | Ampli-con1017554 | 110973 | 390 | 390 | SNP | C | LH82 | T | 5CM1 | | | | |
| 396 | Ampli-con1049957 | 111004 | 181 | 181 | SNP | A | 5CM1 | G | LH82 | | | | |
| 396 | Ampli-con1049957 | 111005 | 246 | 246 | SNP | C | 5CM1 | T | LH82 | | | | |
| 396 | Ampli-con1049957 | 111006 | 268 | 268 | SNP | C | 5CM1 | G | LH82 | | | | |
| 396 | Ampli-con1049957 | 111007 | 284 | 284 | SNP | A | LH82 | T | 5CM1 | | | | |
| 396 | Ampli-con1049957 | 111008 | 349 | 349 | SNP | C | LH82 | G | 5CM1 | | | | |
| 396 | Ampli-con1049957 | 111009 | 559 | 559 | SNP | C | 5CM1 | G | LH82 | | | | |
| 397 | Ampli-con1049995 | 111204 | 254 | 254 | SNP | A | 5CM1 | G | LH82 | | | | |
| 397 | Ampli-con1049995 | 111207 | 509 | 509 | SNP | A | 5CM1 | G | LH82 | | | | |
| 398 | Ampli-con1049999 | 111212 | 165 | 165 | SNP | A | 5CM1 | T | LH82 | | | | |
| 399 | Ampli-con1050057 | 111365 | 76 | 76 | SNP | C | 5CM1 | G | LH82 | | | | |
| 399 | Ampli-con1050057 | 111366 | 139 | 139 | SNP | C | 5CM1 | G | LH82 | | | | |
| 399 | Ampli-con1050057 | 111367 | 258 | 258 | SNP | A | 5CM1 | G | LH82 | | | | |
| 399 | Ampli-con1050057 | 111368 | 600 | 600 | SNP | C | 5CM1 | T | LH82 | | | | |
| 400 | Ampli-con1050089 | 111464 | 114 | 114 | SNP | A | 5CM1 | G | LH82 | | | | |
| 400 | Ampli-con1050089 | 111465 | 183 | 183 | SNP | A | 5CM1 | T | LH82 | | | | |
| 400 | Ampli-con1050089 | 111466 | 410 | 410 | SNP | C | 5CM1 | T | LH82 | | | | |
| 400 | Ampli-con1050089 | 111467 | 468 | 468 | SNP | A | 5CM1 | G | LH82 | | | | |
| 400 | Ampli-con1050089 | 111468 | 485 | 485 | SNP | C | 5CM1 | T | LH82 | | | | |
| 400 | Ampli-con1050089 | 111469 | 489 | 489 | SNP | A | LH82 | G | 5CM1 | | | | |
| 400 | Ampli-con1050089 | 111470 | 518 | 518 | SNP | C | 5CM1 | T | LH82 | | | | |
| 400 | Ampli-con1050089 | 111471 | 527 | 527 | SNP | A | 5CM1 | G | LH82 | | | | |
| 401 | Ampli-con1050090 | 111472 | 221 | 221 | SNP | C | 5CM1 | T | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 402 | Ampli-con1050093 | 111475 | 297 | 297 | SNP | A | LH82 | G | 5CM1 | | | | |
| 403 | Ampli-con1050119 | 111613 | 56 | 56 | SNP | A | LH82 | G | 5CM1 | | | | |
| 403 | Ampli-con1050119 | 111615 | 113 | 113 | SNP | C | LH82 | T | 5CM1 | | | | |
| 403 | Ampli-con1050119 | 111616 | 115 | 115 | SNP | C | LH82 | T | 5CM1 | | | | |
| 403 | Ampli-con1050119 | 111617 | 160 | 160 | SNP | A | LH82 | T | 5CM1 | | | | |
| 403 | Ampli-con1050119 | 111619 | 275 | 275 | SNP | A | 5CM1 | G | LH82 | | | | |
| 403 | Ampli-con1050119 | 111620 | 551 | 551 | IND | * | LH82 | T | 5CM1 | | | | |
| 404 | Ampli-con1050127 | 111628 | 155 | 155 | SNP | A | LH82 | G | 5CM1 | | | | |
| 404 | Ampli-con1050127 | 111629 | 344 | 344 | SNP | C | 5CM1 | T | LH82 | | | | |
| 404 | Ampli-con1050127 | 111630 | 345 | 345 | SNP | A | 5CM1 | G | LH82 | | | | |
| 404 | Ampli-con1050127 | 111631 | 351 | 351 | SNP | C | LH82 | T | 5CM1 | | | | |
| 404 | Ampli-con1050127 | 111632 | 424 | 424 | SNP | C | 5CM1 | T | LH82 | | | | |
| 405 | Ampli-con1050172 | 111817 | 127 | 127 | SNP | A | 5CM1 | G | LH82 | | | | |
| 405 | Ampli-con1050172 | 111818 | 255 | 255 | SNP | A | 5CM1 | G | LH82 | | | | |
| 405 | Ampli-con1050172 | 111819 | 290 | 290 | SNP | A | LH82 | T | 5CM1 | | | | |
| 405 | Ampli-con1050172 | 111820 | 444 | 444 | SNP | A | 5CM1 | T | LH82 | | | | |
| 405 | Ampli-con1050172 | 111821 | 447 | 447 | SNP | C | LH82 | T | 5CM1 | | | | |
| 405 | Ampli-con1050172 | 111822 | 448 | 448 | SNP | A | LH82 | C | 5CM1 | | | | |
| 405 | Ampli-con1050172 | 111823 | 449 | 449 | IND | * | 5CM1 | T | LH82 | | | | |
| 405 | Ampli-con1050172 | 111824 | 452 | 452 | IND | * | 5CM1 | C | LH82 | | | | |
| 405 | Ampli-con1050172 | 111825 | 454 | 454 | IND | * | 5CM1 | C | LH82 | | | | |
| 405 | Ampli-con1050172 | 111826 | 466 | 466 | SNP | A | 5CM1 | G | LH82 | | | | |
| 405 | Ampli-con1050172 | 111827 | 511 | 511 | SNP | C | 5CM1 | T | LH82 | | | | |
| 405 | Ampli-con1050172 | 111828 | 591 | 591 | SNP | C | LH82 | T | 5CM1 | | | | |
| 406 | Ampli-con1050174 | 111829 | 141 | 141 | SNP | G | 5CM1 | T | LH82 | | | | |
| 407 | Ampli-con1050237 | 112139 | 93 | 93 | SNP | C | 5CM1 | G | LH82 | | | | |
| 408 | Ampli-con1050319 | 112496 | 121 | 121 | SNP | A | LH82 | G | 5CM1 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 408 | Ampli-con1050319 | 112497 | 194 | 194 | SNP | A | LH82 | T | 5CM1 | | | | |
| 409 | Ampli-con1050498 | 113113 | 282 | 282 | SNP | A | LH82 | G | 5CM1 | | | | |
| 410 | Ampli-con1050539 | 113263 | 215 | 215 | SNP | A | 5CM1 | G | LH82 | | | | |
| 410 | Ampli-con1050539 | 113264 | 238 | 238 | SNP | C | LH82 | T | 5CM1 | | | | |
| 410 | Ampli-con1050539 | 113265 | 240 | 240 | SNP | C | 5CM1 | T | LH82 | | | | |
| 410 | Ampli-con1050539 | 113266 | 395 | 395 | SNP | C | 5CM1 | G | LH82 | | | | |
| 411 | Ampli-con1050570 | 113377 | 112 | 112 | SNP | A | LH82 | G | 5CM1 | | | | |
| 411 | Ampli-con1050570 | 113378 | 137 | 137 | SNP | C | 5CM1 | T | LH82 | | | | |
| 411 | Ampli-con1050570 | 113379 | 167 | 167 | SNP | A | LH82 | T | 5CM1 | | | | |
| 411 | Ampli-con1050570 | 113380 | 203 | 203 | SNP | A | 5CM1 | G | LH82 | | | | |
| 411 | Ampli-con1050570 | 113381 | 302 | 302 | SNP | A | 5CM1 | G | LH82 | | | | |
| 411 | Ampli-con1050570 | 113382 | 412 | 413 | IND | ** | LH82 | TC | 5CM1 | | | | |
| 412 | Ampli-con1050570 | 143100 | 329 | 329 | SNP | C | LH82 | G | 5CM1 | | | | |
| 412 | Ampli-con1459173 | 143101 | 350 | 350 | SNP | C | 5CM1 | G | LH82 | | | | |
| 412 | Ampli-con1459173 | 143102 | 379 | 379 | SNP | A | 5CM1 | G | LH82 | | | | |
| 412 | Ampli-con1459173 | 143103 | 413 | 413 | IND | * | LH82 | C | 5CM1 | | | | |
| 412 | Ampli-con1459173 | 143104 | 414 | 415 | IND | ** | LH82 | TC | 5CM1 | | | | |
| 413 | Ampli-con1459173 | 143216 | 67 | 67 | SNP | A | mo17:LH82 | C | b73 | | | | |
| 413 | Ampli-con1459183 | 143217 | 321 | 321 | SNP | A | b73 | G | mo17:LH82 | | | | |
| 414 | Ampli-con1459183 | 143249 | 88 | 88 | SNP | C | mo17:5CM1 | T | b73:LH82 | | | | |
| 414 | Ampli-con1459189 | 143251 | 221 | 221 | SNP | A | mo17:5CM1 | G | b73:LH82 | | | | |
| 415 | Ampli-con1459189 | 143371 | 84 | 84 | SNP | G | mo17 | T | b73:5CM1:LH82 | | | | |
| 415 | Ampli-con1459200 | 143372 | 99 | 99 | SNP | A | mo17 | G | b73:5CM1:LH82 | | | | |
| 415 | Ampli-con1459200 | 143374 | 128 | 128 | SNP | C | mo17 | T | b73:5CM1:LH82 | | | | |
| 415 | Ampli-con1459200 | 143375 | 132 | 132 | SNP | A | mo17 | G | b73:5CM1:LH82 | | | | |
| 415 | Ampli-con1459200 | 143376 | 164 | 164 | SNP | C | b73:mo17:LH82 5CM1 | G | 5CM1 | | | | |
| 416 | Ampli-con1459201 | 143380 | 329 | 329 | SNP | A | | G | b73:mo17:LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 416 | Ampli-con1459201 | 143382 | 542 | 542 | SNP | A | b73:mo17:LH82 | C | 5CM1 | | | | |
| 416 | Ampli-con1459201 | 143384 | 634 | 634 | SNP | C | 5CM1 | T | b73:mo17:LH82 | | | | |
| 417 | Ampli-con1459202 | 143386 | 95 | 95 | SNP | A | b73:mo17:LH82 | C | 5CM1 | | | | |
| 417 | Ampli-con1459202 | 143388 | 148 | 148 | SNP | C | b73:LH82 | T | mo17:5CM1 | | | | |
| 418 | Ampli-con1459202 | 143390 | 236 | 236 | SNP | A | 5CM1 | C | b73:mo17:LH82 | | | | |
| 418 | Ampli-con1459202 | 143407 | 115 | 115 | SNP | C | LH82 | T | 5CM1 | | | | |
| 418 | Ampli-con1459206 | 143408 | 381 | 381 | SNP | G | 5CM1 | T | LH82 | | | | |
| 418 | Ampli-con1459206 | 143409 | 516 | 516 | SNP | A | LH82 | C | 5CM1 | | | | |
| 419 | Ampli-con1459206 | 143413 | 70 | 70 | SNP | A | 5CM1 | G | LH82 | | | | |
| 419 | Ampli-con1459208 | 143418 | 205 | 205 | SNP | A | 5CM1 | T | LH82 | | | | |
| 420 | Ampli-con1459208 | 143641 | 113 | 113 | SNP | A | b73:LH82 | C | mo17:5CM1 | | | | |
| 420 | Ampli-con1459219 | 143642 | 187 | 187 | SNP | A | LH82 | T | b73:mo17:5CM1 | | | | |
| 420 | Ampli-con1459219 | 143643 | 209 | 209 | SNP | A | LH82 | G | b73:mo17:5CM1 | | | | |
| 420 | Ampli-con1459219 | 143644 | 247 | 247 | SNP | C | mo17:5CM1:LH82 | T | b73 | | | | |
| 420 | Ampli-con1459219 | 143645 | 285 | 285 | SNP | A | b73:mo17:LH82 | G | 5CM1 | | | | |
| 420 | Ampli-con1459219 | 143646 | 289 | 289 | SNP | C | 5CM1 | T | b73:mo17:LH82 | | | | |
| 420 | Ampli-con1459219 | 143653 | 707 | 707 | IND | * | mo17 | T | b73:5CM1:LH82 | | | | |
| 420 | Ampli-con1459219 | 143654 | 708 | 708 | IND | * | b73:LH82 | A | mo17:5CM1 | | | | |
| 420 | Ampli-con1459219 | 143657 | 883 | 883 | SNP | C | mo17:5CM1 | T | b73:LH82 | | | | |
| 420 | Ampli-con1459219 | 143658 | 946 | 946 | SNP | A | mo17 | T | b73:5CM1:LH82 | | | | |
| 420 | Ampli-con1459219 | 143659 | 985 | 985 | SNP | C | mo17:5CM1:LH82 | G | b73 | | | | |
| 420 | Ampli-con1459219 | 143660 | 1020 | 1020 | SNP | C | b73:LH82 | T | mo17:5CM1 | | | | |
| 421 | Ampli-con1459219 | 143661 | 1146 | 1146 | SNP | A | b73:LH82 | G | mo17:5CM1 | | | | |
| 421 | Ampli-con1459223 | 143749 | 65 | 65 | SNP | C | mo17:LH82 | T | b73:5CM1 | | | | |
| 421 | Ampli-con1459223 | 143750 | 68 | 68 | SNP | C | mo17:LH82 | T | b73:5CM1 | | | | |
| 421 | Ampli-con1459223 | 143753 | 104 | 104 | SNP | A | mo17:LH82 | G | b73:5CM1 | | | | |
| 421 | Ampli-con1459223 | 143754 | 176 | 176 | SNP | C | mo17:LH82 | T | b73:5CM1 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 421 | Ampli-con1459223 | 143755 | 195 | 195 | SNP | C | b73:5CM1 | T | mo17:LH82 | | | | |
| 422 | Ampli-con1459242 | 143969 | 99 | 100 | IND | ** | 5CM1:LH82 | TA | b73:mo17 | | | | |
| 422 | Ampli-con1459242 | 143974 | 520 | 520 | IND | * | mo17 | A | b73:5CM1:LH82 | | | | |
| 423 | Ampli-con1459247 | 144090 | 409 | 409 | SNP | A | 5CM1 | G | b73:mo17:LH82 | | | | |
| 424 | Ampli-con1459269 | 144505 | 45 | 45 | SNP | C | b73 | T | mo17:5CM1:LH82 | | | | |
| 424 | Ampli-con1459269 | 144506 | 88 | 91 | IND | **** | b73 | TCTA | mo17:5CM1:LH82 | | | | |
| 425 | Ampli-con1459275 | 144686 | 108 | 108 | SNP | C | 5CM1 | G | b73:mo17:LH82 | | | | |
| 425 | Ampli-con1459275 | 144687 | 260 | 260 | SNP | A | mo17:5CM1 | T | b73:LH82 | | | | |
| 425 | Ampli-con1459275 | 144688 | 362 | 362 | SNP | A | b73:mo17:5CM1 | C | LH82 | | | | |
| 425 | Ampli-con1459275 | 144689 | 399 | 401 | IND | *** | b73:mo17:5CM1 | ACC | LH82 | | | | |
| 426 | Ampli-con1459275 | 144731 | 169 | 169 | SNP | A | b73:mo17:5CM1 | G | LH82 | | | | |
| 426 | Ampli-con1459277 | 144732 | 238 | 238 | SNP | A | b73:mo17:5CM1 | G | LH82 | | | | |
| 427 | Ampli-con1459277 | 145065 | 28 | 28 | SNP | A | b73 | G | mo17:LH82 | | | | |
| 427 | Ampli-con1459294 | 145066 | 38 | 38 | SNP | G | b73 | T | mo17:LH82 | | | | |
| 427 | Ampli-con1459294 | 145069 | 110 | 110 | SNP | C | mo17:LH82 | T | b73 | | | | |
| 427 | Ampli-con1459294 | 145070 | 116 | 116 | SNP | C | mo17:LH82 | T | b73 | | | | |
| 427 | Ampli-con1459294 | 145071 | 119 | 119 | SNP | C | mo17:LH82 | T | b73 | | | | |
| 427 | Ampli-con1459294 | 145072 | 127 | 127 | SNP | C | b73 | T | mo17:LH82 | | | | |
| 428 | Ampli-con1459294 | 145073 | 133 | 133 | SNP | A | mo17:LH82 | C | b73 | | | | |
| 428 | Ampli-con1459300 | 145077 | 468 | 468 | SNP | A | mo17:LH82 | C | b73 | | | | |
| 428 | Ampli-con1459300 | 145200 | 102 | 102 | SNP | C | b73 | G | mo17:5CM1:LH82 | | | | |
| 428 | Ampli-con1459300 | 145202 | 176 | 176 | SNP | A | b73 | G | mo17:5CM1:LH82 | | | | |
| 428 | Ampli-con1459300 | 145203 | 177 | 177 | SNP | A | b73 | C | mo17:5CM1:LH82 | | | | |
| 428 | Ampli-con1459300 | 145204 | 271 | 271 | SNP | C | b73 | G | mo17:5CM1:LH82 | | | | |
| 428 | Ampli-con1459300 | 145205 | 454 | 457 | IND | **** | mo17:LH82 | ACGT | b73:5CM1 | | | | |
| 429 | Ampli-con1459304 | 145260 | 158 | 158 | SNP | A | 5CM1 | C | LH82 | | | | |
| 429 | Ampli-con1459304 | 145261 | 172 | 172 | SNP | C | LH82 | G | 5CM1 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 429 | Ampli-con1459304 | 145263 | 235 | 235 | SNP | C | 5CM1 | T | LH82 | | | | |
| 429 | Ampli-con1459304 | 145264 | 525 | 525 | SNP | C | 5CM1 | T | LH82 | | | | |
| 429 | Ampli-con1459304 | 145266 | 574 | 574 | SNP | C | 5CM1 | T | LH82 | | | | |
| 430 | Ampli-con1459307 | 145298 | 58 | 58 | SNP | G | b73 | T | mo17 | | | | |
| 430 | Ampli-con1459307 | 145299 | 92 | 92 | IND | * | mo17 | C | b73 | | | | |
| 430 | Ampli-con1459307 | 145300 | 377 | 377 | SNP | A | b73 | G | mo17 | | | | |
| 430 | Ampli-con1459307 | 145301 | 380 | 380 | SNP | A | b73 | G | mo17 | | | | |
| 430 | Ampli-con1459307 | 145302 | 393 | 393 | SNP | G | b73 | T | mo17 | | | | |
| 430 | Ampli-con1459307 | 145303 | 399 | 399 | SNP | A | mo17 | G | b73 | | | | |
| 430 | Ampli-con1459307 | 145304 | 407 | 407 | SNP | A | mo17 | G | b73 | | | | |
| 430 | Ampli-con1459307 | 145305 | 410 | 410 | SNP | A | mo17 | G | b73 | | | | |
| 430 | Ampli-con1459307 | 145306 | 416 | 416 | SNP | A | mo17 | G | b73 | | | | |
| 430 | Ampli-con1459307 | 145307 | 432 | 432 | SNP | G | mo17 | T | b73 | | | | |
| 430 | Ampli-con1459307 | 145308 | 434 | 434 | IND | * | mo17 | A | b73 | | | | |
| 430 | Ampli-con1459307 | 145309 | 488 | 488 | SNP | A | mo17 | C | b73 | | | | |
| 430 | Ampli-con1459307 | 145310 | 498 | 498 | SNP | C | b73 | T | mo17 | | | | |
| 430 | Ampli-con1459307 | 145312 | 244 | 244 | SNP | A | b73 | G | mo17 | | | | |
| 431 | Ampli-con1459308 | 145314 | 294 | 294 | IND | * | mo17 | T | b73 | | | | |
| 431 | Ampli-con1459308 | 145315 | 314 | 314 | SNP | G | mo17 | T | b73 | | | | |
| 431 | Ampli-con1459308 | 145316 | 426 | 426 | IND | * | mo17 | A | b73 | | | | |
| 431 | Ampli-con1459308 | 145317 | 429 | 429 | IND | * | mo17 | T | b73 | | | | |
| 431 | Ampli-con1459308 | 145318 | 464 | 464 | SNP | A | mo17 | G | b73 | | | | |
| 431 | Ampli-con1459308 | 145319 | 533 | 533 | SNP | A | mo17 | T | b73 | | | | |
| 432 | Ampli-con1459308 | 145322 | 912 | 912 | SNP | C | mo17 | T | b73 | | | | |
| 433 | Ampli-con1459309 | 145573 | 243 | 243 | SNP | A | b73:mo17:LH82 | G | 5CM1 | | | | |
| 433 | Ampli-con1459322 | 145574 | 312 | 312 | SNP | C | 5CM1:LH82 | T | b73:mo17 | | | | |
| 433 | Ampli-con1459322 | 145575 | 406 | 406 | SNP | A | 5CM1 | G | b73:mo17:LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 433 | Ampli-con1459322 | 145577 | 451 | 451 | SNP | C | 5CM1:LH82 | T | b73:mo17 | | | | |
| 433 | Ampli-con1459322 | 145578 | 519 | 519 | SNP | A | 5CM1 | T | b73:mo17:LH82 | | | | |
| 433 | Ampli-con1459322 | 145579 | 550 | 550 | SNP | G | 5CM1 | T | b73:mo17:LH82 | | | | |
| 433 | Ampli-con1459322 | 145580 | 611 | 611 | SNP | A | b73:mo17:5CM1 | T | LH82 | | | | |
| 433 | Ampli-con1459322 | 145581 | 652 | 652 | SNP | A | b73:mo17:LH82 | C | 5CM1 | | | | |
| 433 | Ampli-con1459322 | 145582 | 656 | 656 | SNP | A | 5CM1 | G | b73:mo17:LH82 | | | | |
| 433 | Ampli-con1459322 | 145583 | 657 | 657 | SNP | C | b73:mo17:LH82 | T | 5CM1 | | | | |
| 433 | Ampli-con1459322 | 145584 | 677 | 677 | SNP | A | b73:mo17:LH82 | G | 5CM1 | | | | |
| 433 | Ampli-con1459322 | 145585 | 685 | 685 | SNP | A | b73:mo17:LH82 | C | 5CM1 | | | | |
| 433 | Ampli-con1459322 | 145586 | 703 | 703 | IND | * | b73:mo17 | A | 5CM1:LH82 | | | | |
| 433 | Ampli-con1459322 | 145587 | 713 | 734 | IND | *********************** | b73:mo17:LH82 | GTTGATGAAGCAGGACATTGGG | 5CM1 | | | | |
| 433 | Ampli-con1459322 | 145588 | 784 | 784 | SNP | A | 5CM1 | G | b73:mo17:LH82 | | | | |
| 433 | Ampli-con1459322 | 145590 | 857 | 857 | SNP | G | b73:mo17:LH82 | T | 5CM1 | | | | |
| 433 | Ampli-con1459322 | 145591 | 864 | 864 | SNP | A | 5CM1 | G | b73:mo17:LH82 | | | | |
| 433 | Ampli-con1459322 | 145592 | 868 | 868 | SNP | A | b73:mo17:LH82 | C | 5CM1 | | | | |
| 433 | Ampli-con1459322 | 145594 | 877 | 877 | IND | * | b73:mo17:LH82 | C | 5CM1 | | | | |
| 433 | Ampli-con1459322 | 145596 | 889 | 892 | IND | **** | b73:mo17:LH82 | CCAA | 5CM1:LH82 | | | | |
| 433 | Ampli-con1459322 | 145597 | 905 | 905 | SNP | A | b73:mo17:LH82 | G | 5CM1 | | | | |
| 434 | Ampli-con1459334 | 145794 | 242 | 242 | SNP | C | mo17:5CM1 | T | b73 | | | | |
| 434 | Ampli-con1459334 | 145796 | 419 | 419 | SNP | C | b73 | T | mo17:5CM1 | | | | |
| 434 | Ampli-con1459334 | 145797 | 428 | 428 | SNP | C | b73 | T | mo17:5CM1 | | | | |
| 434 | Ampli-con1459334 | 145798 | 747 | 747 | SNP | A | b73 | G | mo17:5CM1 | | | | |
| 434 | Ampli-con1459334 | 145800 | 867 | 867 | SNP | C | mo17:5CM1 | T | b73 | | | | |
| 434 | Ampli-con1459334 | 145801 | 930 | 930 | SNP | A | mo17:5CM1 | T | b73 | | | | |
| 434 | Ampli-con1459334 | 145802 | 969 | 969 | SNP | C | mo17:5CM1 | G | b73 | | | | |
| 434 | Ampli-con1459334 | 145803 | 1004 | 1004 | SNP | C | b73 | T | mo17:5CM1 | | | | |
| 435 | Ampli-con1459354 | 146152 | 254 | 254 | SNP | A | 5CM1 | G | b73:mo17:LH82 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 435 | Ampli-con1459354 | 146158 | 821 | 822 | IND | ** | 5CM1 | CA | b73:mo17:LH82 b73 | | | | |
| 436 | Ampli-con1459358 | 146190 | 203 | 203 | SNP | G | mo17:5CM1: LH82 | T | mo17:5CM1: LH82 b73 | | | | |
| 436 | Ampli-con1459358 | 146191 | 272 | 272 | SNP | A | mo17:5CM1: LH82 | G | b73 | | | | |
| 436 | Ampli-con1459358 | 146192 | 286 | 286 | SNP | A | mo17:5CM1: LH82 | C | b73 | | | | |
| 436 | Ampli-con1459358 | 146193 | 301 | 301 | SNP | G | b73 | T | mo17:5CM1: LH82 b73:5CM1 | | | | |
| 436 | Ampli-con1459358 | 146194 | 327 | 327 | SNP | A | mo17:LH82 | G | b73:5CM1 | | | | |
| 436 | Ampli-con1459358 | 146195 | 348 | 348 | SNP | C | mo17:5CM1: LH82 | G | b73 | | | | |
| 436 | Ampli-con1459358 | 146196 | 425 | 425 | SNP | A | mo17:5CM1: LH82 | G | b73 | | | | |
| 436 | Ampli-con1459358 | 146197 | 448 | 448 | SNP | C | b73 | G | mo17:5CM1: LH82 5CM1 | | | | |
| 437 | Ampli-con1459369 | 146410 | 123 | 123 | SNP | G | b73:LH82 | T | b73:mo17: LH82 5CM1 | | | | |
| 437 | Ampli-con1459369 | 146411 | 154 | 159 | IND | ******* | 5CM1 | ATCTTC | b73:mo17: LH82 | | | | |
| 437 | Ampli-con1459369 | 146412 | 280 | 280 | SNP | C | 5CM1 | T | b73:mo17: LH82 | | | | |
| 437 | Ampli-con1459369 | 146413 | 330 | 330 | SNP | A | LH82 | T | b73:mo17: 5CM1 | | | | |
| 437 | Ampli-con1459369 | 146414 | 331 | 331 | SNP | A | LH82 | C | b73:mo17: 5CM1 | | | | |
| 437 | Ampli-con1459369 | 146415 | 345 | 345 | SNP | A | b73:LH82 | T | mo17:5CM1 | | | | |
| 437 | Ampli-con1459369 | 146416 | 552 | 552 | SNP | G | b73:mo17: LH82 | T | 5CM1 | | | | |
| 437 | Ampli-con1459369 | 146417 | 555 | 555 | SNP | C | b73:mo17: LH82 | G | 5CM1 | | | | |
| 437 | Ampli-con1459369 | 146418 | 556 | 556 | SNP | G | 5CM1 | T | b73:mo17: LH82 | | | | |
| 437 | Ampli-con1459369 | 146419 | 558 | 558 | SNP | G | b73:mo17: LH82 | T | 5CM1 | | | | |
| 437 | Ampli-con1459369 | 146420 | 559 | 559 | SNP | A | LH82 | T | b73:mo17: 5CM1 | | | | |
| 437 | Ampli-con1459369 | 146421 | 560 | 560 | SNP | A | 5CM1 | T | b73:mo17: LH82 | | | | |
| 437 | Ampli-con1459369 | 146422 | 561 | 561 | SNP | A | 5CM1 | T | b73:mo17: LH82 | | | | |
| 437 | Ampli-con1459369 | 146423 | 562 | 562 | SNP | G | b73:mo17: LH82 | T | 5CM1 | | | | |
| 437 | Ampli-con1459369 | 146424 | 563 | 563 | SNP | A | 5CM1 | G | b73:mo17: LH82 | | | | |
| 437 | Ampli-con1459369 | 146425 | 564 | 564 | SNP | A | 5CM1 | G | b73:mo17: LH82 | | | | |
| 437 | Ampli-con1459369 | 146426 | 565 | 565 | SNP | A | 5CM1 | T | b73:mo17: LH82 | | | | |
| 437 | Ampli-con1459369 | 146427 | 566 | 566 | SNP | A | b73:mo17: LH82 | C | 5CM1 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 437 | Ampli-con1459369 | 146428 | 568 | 568 | SNP | C | 5CM1 | T | b73:mo17:LH82 | | | | |
| 437 | Ampli-con1459369 | 146429 | 569 | 569 | SNP | C | b73:mo17:LH82 5CM1 | G | | | | | |
| 437 | Ampli-con1459369 | 146430 | 570 | 570 | SNP | A | 5CM1 | T | b73:mo17:LH82 | | | | |
| 437 | Ampli-con1459369 | 146431 | 574 | 574 | SNP | A | b73:mo17:LH82 5CM1 | T | | | | | |
| 437 | Ampli-con1459369 | 146432 | 575 | 575 | SNP | A | 5CM1 | T | b73:mo17:LH82 | | | | |
| 437 | Ampli-con1459369 | 146433 | 576 | 576 | SNP | G | 5CM1 | T | b73:mo17:LH82 | | | | |
| 437 | Ampli-con1459369 | 146434 | 577 | 577 | SNP | A | 5CM1 | G | b73:mo17:LH82 | | | | |
| 437 | Ampli-con1459369 | 146435 | 578 | 578 | SNP | A | b73:mo17:LH82 5CM1 | T | | | | | |
| 437 | Ampli-con1459369 | 146436 | 580 | 580 | SNP | C | 5CM1 | G | b73:mo17:LH82 | | | | |
| 437 | Ampli-con1459369 | 146437 | 581 | 581 | SNP | A | 5CM1 | T | b73:mo17:LH82 | | | | |
| 437 | Ampli-con1459369 | 146438 | 582 | 582 | SNP | A | 5CM1 | G | b73:mo17:LH82 | | | | |
| 437 | Ampli-con1459369 | 146439 | 583 | 583 | SNP | A | 5CM1 | G | b73:mo17:LH82 | | | | |
| 437 | Ampli-con1459369 | 146441 | 587 | 587 | SNP | A | b73:mo17:LH82 | C | 5CM1 | | | | |
| 437 | Ampli-con1459369 | 146442 | 588 | 588 | SNP | A | b73:mo17:LH82 | T | 5CM1 | | | | |
| 437 | Ampli-con1459369 | 146443 | 589 | 589 | SNP | G | b73:mo17:LH82 | T | 5CM1 | | | | |
| 437 | Ampli-con1459369 | 146444 | 590 | 590 | SNP | C | 5CM1 | G | b73:mo17:LH82 | | | | |
| 437 | Ampli-con1459369 | 146445 | 592 | 592 | SNP | C | 5CM1 | G | b73:mo17:LH82 | | | | |
| 437 | Ampli-con1459369 | 146446 | 593 | 593 | SNP | A | 5CM1 | T | b73:mo17:LH82 | | | | |
| 437 | Ampli-con1459369 | 146447 | 594 | 594 | SNP | C | b73:mo17:LH82 | T | 5CM1 | | | | |
| 437 | Ampli-con1459369 | 146448 | 595 | 595 | SNP | A | 5CM1 | G | b73:mo17:LH82 | | | | |
| 437 | Ampli-con1459369 | 146449 | 597 | 597 | SNP | A | b73:mo17:LH82 | C | 5CM1 | | | | |
| 437 | Ampli-con1459369 | 146450 | 598 | 598 | SNP | A | b73:mo17:LH82 | T | 5CM1 | | | | |
| 438 | Ampli-con1459371 | 146458 | 233 | 233 | SNP | G | b73 | T | mo17:5CM1:LH82 | | | | |
| 438 | Ampli-con1459371 | 146459 | 246 | 246 | SNP | A | b73 | T | mo17:5CM1:LH82 | | | | |
| 438 | Ampli-con1459371 | 146460 | 419 | 419 | SNP | C | 5CM1 | G | b73:mo17:LH82 | | | | |
| 439 | Ampli-con1459380 | 146534 | 123 | 123 | SNP | C | b73 | T | mo17:5CM1 | | | | |
| 439 | Ampli-con1459380 | 146535 | 141 | 141 | SNP | C | b73 | T | mo17:5CM1 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 439 | Ampli-con1459380 | 146538 | 1015 | 1015 | SNP | G | b73:5CM1 | T | mo17 | | | | |
| 439 | Ampli-con1459380 | 146539 | 1017 | 1017 | SNP | A | b73:5CM1 | C | mo17 | | | | |
| 440 | Ampli-con1459387 | 146593 | 140 | 140 | SNP | C | b73:mo17:5CM1 | G | LH82 | | | | |
| 441 | Ampli-con1459392 | 147037 | 96 | 96 | SNP | C | mo17 | G | b73:5CM1:LH82 | | | | |
| 441 | Ampli-con1459392 | 147039 | 238 | 241 | IND | **** | b73:5CM1:LH82 | CTAT | mo17 | | | | |
| 441 | Ampli-con1459392 | 147041 | 362 | 362 | SNP | G | 5CM1 | T | b73:mo17:LH82 | | | | |
| 441 | Ampli-con1459392 | 147043 | 415 | 415 | SNP | A | b73:mo17:LH82 | G | 5CM1 | | | | |
| 442 | Ampli-con1459392 | 147044 | 464 | 464 | SNP | C | LH82 | T | 5CM1 | | | | |
| 442 | Ampli-con1459402 | 147181 | 148 | 148 | SNP | C | LH82 | G | 5CM1 | | | | |
| 442 | Ampli-con1459402 | 147182 | 183 | 183 | SNP | A | LH82 | G | 5CM1 | | | | |
| 442 | Ampli-con1459402 | 147183 | 303 | 303 | SNP | C | LH82 | T | 5CM1 | | | | |
| 442 | Ampli-con1459402 | 147184 | 305 | 305 | SNP | G | 5CM1 | T | LH82 | | | | |
| 442 | Ampli-con1459402 | 147186 | 348 | 348 | SNP | G | LH82 | G | 5CM1 | | | | |
| 442 | Ampli-con1459402 | 147187 | 396 | 396 | SNP | C | LH82 | G | 5CM1 | | | | |
| 442 | Ampli-con1459402 | 147188 | 422 | 422 | SNP | C | LH82 | T | 5CM1 | | | | |
| 442 | Ampli-con1459402 | 147189 | 477 | 485 | IND | ********** | 5CM1 | TATTGTTTT | LH82 | | | | |
| 442 | Ampli-con1459402 | 147190 | 488 | 491 | IND | **** | 5CM1 | CCTT | LH82 | | | | |
| 442 | Ampli-con1459402 | 147191 | 496 | 496 | IND | * | 5CM1 | A | LH82 | | | | |
| 442 | Ampli-con1459402 | 147192 | 506 | 506 | SNP | C | LH82 | T | 5CM1 | | | | |
| 443 | Ampli-con1459402 | 147216 | 63 | 63 | SNP | A | b73:LH82 | G | 5CM1 | | | | |
| 443 | Ampli-con1459406 | 147217 | 64 | 64 | SNP | C | LH82 | T | 5CM1 | | | | |
| 443 | Ampli-con1459406 | 147218 | 104 | 104 | SNP | C | LH82 | T | 5CM1 | | | | |
| 443 | Ampli-con1459406 | 147219 | 145 | 145 | SNP | A | LH82 | G | b73:5CM1 | | | | |
| 443 | Ampli-con1459406 | 147220 | 253 | 253 | SNP | A | LH82 | G | b73:5CM1 | | | | |
| 443 | Ampli-con1459406 | 147221 | 324 | 324 | SNP | A | LH82 | G | b73:5CM1 | | | | |
| 443 | Ampli-con1459406 | 147222 | 325 | 325 | IND | * | LH82 | G | b73:5CM1 | | | | |
| 443 | Ampli-con1459406 | 147223 | 409 | 409 | SNP | A | b73:5CM1 | G | LH82 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 444 | Ampli-con1459414 | 147406 | 61 | 61 | SNP | G | b73:mo17:5CM1 | T | LH82 | | | | |
| 444 | Ampli-con1459414 | 147407 | 79 | 79 | SNP | G | LH82 | T | b73:mo17:5CM1 | | | | |
| 444 | Ampli-con1459414 | 147408 | 81 | 81 | SNP | C | mo17:LH82 | T | b73:5CM1 | | | | |
| 444 | Ampli-con1459414 | 147409 | 91 | 91 | SNP | C | LH82 | T | b73:mo17:5CM1 | | | | |
| 444 | Ampli-con1459414 | 147410 | 159 | 159 | IND | * | b73:mo17:5CM1 | C | LH82 | | | | |
| 444 | Ampli-con1459414 | 147411 | 207 | 207 | SNP | C | mo17 | T | b73:5CM1:LH82 | | | | |
| 444 | Ampli-con1459414 | 147412 | 415 | 415 | SNP | C | b73 | T | mo17:5CM1:LH82 | | | | |
| 444 | Ampli-con1459414 | 147414 | 453 | 453 | SNP | G | b73:5CM1:LH82 | T | mo17 | | | | |
| 444 | Ampli-con1459414 | 147416 | 493 | 493 | SNP | C | b73:5CM1 | T | mo17:LH82 | | | | |
| 445 | Ampli-con1459414 | 147417 | 82 | 82 | SNP | C | b73 | G | mo17:5CM1:LH82 | | | | |
| 446 | Ampli-con1459415 | 147478 | 165 | 165 | SNP | C | b73:LH82 | G | mo17:5CM1 | | | | |
| 446 | Ampli-con1459421 | 147480 | 205 | 205 | SNP | A | b73:LH82 | G | mo17:5CM1 | | | | |
| 446 | Ampli-con1459421 | 147481 | 226 | 226 | SNP | A | b73:LH82 | C | mo17:5CM1 | | | | |
| 446 | Ampli-con1459421 | 147482 | 259 | 259 | SNP | A | b73:LH82 | G | mo17:5CM1 | | | | |
| 446 | Ampli-con1459421 | 147484 | 316 | 316 | SNP | C | mo17:5CM1 | T | b73:LH82 | | | | |
| 446 | Ampli-con1459421 | 147485 | 355 | 355 | SNP | A | b73:mo17:5CM1 | T | LH82 | | | | |
| 446 | Ampli-con1459421 | 147487 | 375 | 375 | SNP | A | mo17:5CM1 | G | b73:LH82 | | | | |
| 446 | Ampli-con1459421 | 147488 | 391 | 391 | SNP | A | mo17:5CM1 | T | b73:LH82 | | | | |
| 446 | Ampli-con1459421 | 147489 | 400 | 400 | SNP | A | 5CM1 | G | b73:mo17:LH82 | | | | |
| 446 | Ampli-con1459421 | 147496 | 539 | 539 | SNP | G | b73:LH82 | T | b73:mo17:LH82 | | | | |
| 446 | Ampli-con1459421 | 147498 | 577 | 577 | SNP | A | mo17:5CM1 | G | b73:LH82 | | | | |
| 446 | Ampli-con1459421 | 147499 | 631 | 631 | SNP | C | b73:LH82 | T | mo17:5CM1 | | | | |
| 446 | Ampli-con1459421 | 147500 | 650 | 650 | SNP | A | b73:LH82 | G | mo17:5CM1 | | | | |
| 446 | Ampli-con1459421 | 147501 | 660 | 660 | SNP | C | b73:LH82 | T | mo17:5CM1 | | | | |
| 446 | Ampli-con1459421 | 147502 | 740 | 740 | SNP | A | b73:LH82 | G | mo17:5CM1 | | | | |
| 446 | Ampli-con1459421 | 147504 | 820 | 820 | SNP | C | b73:LH82 | T | mo17:5CM1 | | | | |
| 446 | Ampli-con1459421 | 147505 | 822 | 822 | SNP | C | mo17:5CM1 | T | b73:LH82 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 446 | Ampli-con1459421 | 147506 | 866 | 866 | SNP | A | mo17:5CM1 | T | b73:LH82 | | | | |
| 446 | Ampli-con1459421 | 147507 | 907 | 907 | IND | * | mo17 | C | b73:5CM1:LH82 mo17:5CM1 | | | | |
| 446 | Ampli-con1459421 | 147509 | 912 | 912 | SNP | C | b73:LH82 | G | mo17:5CM1 | | | | |
| 447 | Ampli-con1459422 | 147511 | 144 | 144 | SNP | A | b73 | G | mo17:5CM1:LH82 | | | | |
| 447 | Ampli-con1459422 | 147512 | 174 | 174 | SNP | C | b73:mo17:LH82 5CM1 | T | 5CM1 | | | | |
| 447 | Ampli-con1459422 | 147513 | 177 | 177 | SNP | A | b73:mo17:LH82 5CM1 | G | b73:mo17:LH82 5CM1 | | | | |
| 447 | Ampli-con1459422 | 147514 | 281 | 283 | IND | *** | b73:mo17:LH82 | TAA | b73:mo17:LH82 | | | | |
| 447 | Ampli-con1459422 | 147515 | 334 | 334 | SNP | A | b73:5CM1 | T | mo17:LH82 | | | | |
| 447 | Ampli-con1459422 | 147516 | 416 | 416 | SNP | A | 5CM1 | G | b73:LH82 | | | | |
| 447 | Ampli-con1459422 | 147517 | 508 | 508 | SNP | C | b73 | T | mo17:5CM1:LH82 | | | | |
| 447 | Ampli-con1459422 | 147518 | 581 | 581 | SNP | A | mo17:LH82 | C | b73:5CM1 | | | | |
| 447 | Ampli-con1459422 | 147519 | 621 | 621 | SNP | A | mo17:5CM1:LH82 | C | b73 | | | | |
| 447 | Ampli-con1459422 | 147520 | 630 | 630 | SNP | G | mo17:5CM1:LH82 | T | b73 | | | | |
| 447 | Ampli-con1459422 | 147521 | 641 | 641 | SNP | G | b73:5CM1 | T | mo17:LH82 | | | | |
| 447 | Ampli-con1459422 | 147522 | 648 | 648 | SNP | A | mo17:LH82 | T | b73:5CM1 | | | | |
| 447 | Ampli-con1459422 | 147523 | 656 | 656 | SNP | G | b73:mo17:LH82 | T | 5CM1 | | | | |
| 447 | Ampli-con1459422 | 147525 | 697 | 697 | SNP | C | b73:mo17:LH82 | T | 5CM1 | | | | |
| 447 | Ampli-con1459422 | 147526 | 734 | 734 | SNP | C | mo17:LH82 | G | b73:5CM1 | | | | |
| 447 | Ampli-con1459422 | 147527 | 759 | 759 | SNP | C | 5CM1 | T | b73:mo17:LH82 | | | | |
| 447 | Ampli-con1459422 | 147528 | 788 | 788 | SNP | C | 5CM1 | T | b73:mo17:LH82 | | | | |
| 447 | Ampli-con1459422 | 147529 | 791 | 791 | SNP | C | b73 | G | mo17:5CM1:LH82 | | | | |
| 447 | Ampli-con1459422 | 147530 | 792 | 792 | SNP | A | b73 | G | mo17:5CM1:LH82 | | | | |
| 447 | Ampli-con1459422 | 147531 | 830 | 830 | SNP | C | b73:mo17:LH82 | T | 5CM1 | | | | |
| 447 | Ampli-con1459422 | 147532 | 849 | 849 | SNP | C | b73:mo17:LH82 | T | 5CM1 | | | | |
| 447 | Ampli-con1459422 | 147533 | 868 | 868 | SNP | C | mo17:LH82 | T | b73:5CM1 | | | | |
| 447 | Ampli-con1459422 | 147535 | 908 | 908 | SNP | A | 5CM1 | C | b73:mo17:LH82 | | | | |
| 447 | Ampli-con1459422 | 147536 | 921 | 921 | SNP | A | 5CM1 | G | b73:mo17:LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 447 | Ampli-con1459422 | 147537 | 928 | 928 | SNP | G | b73:mo17:LH82 | T | 5CM1 | | | | |
| 447 | Ampli-con1459422 | 147538 | 943 | 947 | IND | ***** | 5CM1 | CTTGT | b73:mo17:LH82 | | | | |
| 447 | Ampli-con1459422 | 147539 | 961 | 961 | SNP | C | mo17:5CM1:LH82 | T | b73 | | | | |
| 447 | Ampli-con1459422 | 147540 | 966 | 966 | SNP | A | b73:mo17:LH82 | T | 5CM1 | | | | |
| 447 | Ampli-con1459422 | 147541 | 1142 | 1142 | SNP | G | b73:mo17:LH82 | T | 5CM1 | | | | |
| 448 | Ampli-con1459423 | 147542 | 183 | 183 | SNP | C | b73:5CM1:LH82 | T | mo17 | | | | |
| 448 | Ampli-con1459423 | 147543 | 455 | 455 | SNP | C | LH82 | T | b73:5CM1:mo17 | | | | |
| 448 | Ampli-con1459423 | 147544 | 533 | 540 | IND | ********* | b73:5CM1:LH82 | ATTGAAAT | mo17 | | | | |
| 448 | Ampli-con1459423 | 147545 | 650 | 650 | SNP | C | mo17 | T | b73:5CM1:LH82 | | | | |
| 448 | Ampli-con1459423 | 147546 | 851 | 851 | SNP | C | mo17 | T | b73:5CM1:LH82 | | | | |
| 448 | Ampli-con1459423 | 147548 | 1046 | 1046 | SNP | A | mo17 | G | b73:5CM1:LH82 | | | | |
| 449 | Ampli-con1459443 | 147767 | 279 | 279 | SNP | G | b73:mo17:LH82 | T | mo17:5CM1:LH82 | | | | |
| 449 | Ampli-con1459443 | 147768 | 429 | 429 | SNP | C | mo17:5CM1:LH82 | T | b73 | | | | |
| 449 | Ampli-con1459443 | 147771 | 483 | 483 | SNP | C | b73:mo17:LH82 | T | 5CM1 | | | | |
| 449 | Ampli-con1459443 | 147772 | 620 | 620 | SNP | A | b73 | T | mo17:5CM1:LH82 | | | | |
| 449 | Ampli-con1459443 | 147773 | 627 | 627 | SNP | A | mo17:5CM1:LH82 | G | b73 | | | | |
| 450 | Ampli-con1460617 | 148018 | 61 | 61 | SNP | C | mo17 | G | b73:LH82 | | | | |
| 450 | Ampli-con1460617 | 148019 | 112 | 112 | SNP | A | b73:LH82 | C | mo17 | | | | |
| 450 | Ampli-con1460617 | 148020 | 224 | 224 | SNP | G | b73:LH82 | T | mo17 | | | | |
| 450 | Ampli-con1460617 | 148021 | 228 | 228 | SNP | C | b73 | G | mo17:LH82 | | | | |
| 450 | Ampli-con1460617 | 148022 | 235 | 235 | SNP | A | LH82 | C | b73:mo17 | | | | |
| 450 | Ampli-con1460617 | 148023 | 245 | 247 | IND | *** | mo17:LH82 | GTC | b73 | | | | |
| 450 | Ampli-con1460617 | 148024 | 283 | 291 | IND | ********* | mo17 | ACGTACGGT | b73:LH82 | | | | |
| 450 | Ampli-con1460617 | 148026 | 329 | 332 | IND | **** | mo17:LH82 | GTAC | b73 | | | | |
| 450 | Ampli-con1460617 | 148027 | 354 | 357 | IND | **** | b73:mo17 | CATC | LH82 | | | | |
| 450 | Ampli-con1460617 | 148028 | 382 | 383 | IND | ** | mo17:LH82 | CA | b73 | | | | |
| 450 | Ampli-con1460617 | 148029 | 426 | 431 | IND | ******* | b73:LH82 | CTGTGT | mo17 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 450 | Ampli-con1460617 | 148030 | 442 | 442 | SNP | C | b73:LH82 | G | mo17 | | | | |
| 450 | Ampli-con1460617 | 148031 | 454 | 456 | IND | *** | b73:LH82 | TAC | mo17 | | | | |
| 450 | Ampli-con1460617 | 148032 | 462 | 462 | SNP | C | mo17 | G | b73:LH82 | | | | |
| 451 | Ampli-con1460632 | 148155 | 229 | 229 | SNP | A | b73:LH82 | C | mo17:5CM1 | | | | |
| 451 | Ampli-con1460632 | 148156 | 280 | 280 | SNP | A | mo17:5CM1 | C | b73:LH82 | | | | |
| 451 | Ampli-con1460632 | 148157 | 546 | 546 | SNP | A | b73:LH82 | C | mo17:5CM1 | | | | |
| 451 | Ampli-con1460632 | 148158 | 587 | 587 | SNP | A | mo17:5CM1:LH82 | G | b73 | | | | |
| 451 | Ampli-con1460632 | 148159 | 613 | 613 | SNP | C | mo17:5CM1:LH82 | T | b73 | | | | |
| 452 | Ampli-con1460638 | 148194 | 467 | 467 | SNP | A | 5CM1 | G | b73 | | | | |
| 453 | Ampli-con1460644 | 148039 | 94 | 94 | SNP | C | b73:5CM1 | T | mo17:LH82 | | | | |
| 453 | Ampli-con1460644 | 148040 | 115 | 115 | SNP | A | LH82 | C | b73:mo17:5CM1 | | | | |
| 453 | Ampli-con1460644 | 148041 | 125 | 125 | SNP | C | 5CM1 | T | b73:mo17:LH82 | | | | |
| 453 | Ampli-con1460644 | 148042 | 139 | 139 | IND | * | 5CM1 | C | b73:mo17:LH82 | | | | |
| 453 | Ampli-con1460644 | 148043 | 146 | 146 | SNP | A | mo17 | C | b73:5CM1:LH82 | | | | |
| 453 | Ampli-con1460644 | 148044 | 171 | 171 | SNP | A | b73:5CM1 | G | mo17:LH82 | | | | |
| 453 | Ampli-con1460644 | 148045 | 190 | 190 | SNP | C | b73:mo17:5CM1 | G | LH82 | | | | |
| 453 | Ampli-con1460644 | 148046 | 192 | 192 | SNP | A | b73:5CM1 | G | mo17:LH82 | | | | |
| 453 | Ampli-con1460644 | 148047 | 209 | 209 | SNP | A | b73:5CM1 | G | LH82 | | | | |
| 453 | Ampli-con1460644 | 148048 | 217 | 217 | SNP | C | b73:mo17:5CM1:LH82 | T | | | | | |
| 453 | Ampli-con1460644 | 148049 | 222 | 222 | SNP | A | LH82 | G | b73:mo17:5CM1 | | | | |
| 453 | Ampli-con1460644 | 148050 | 252 | 252 | SNP | A | b73:5CM1 | G | mo17:LH82 | | | | |
| 453 | Ampli-con1460644 | 148051 | 258 | 258 | SNP | A | b73:5CM1 | G | mo17:LH82 | | | | |
| 453 | Ampli-con1460644 | 148052 | 273 | 273 | SNP | A | b73:5CM1:LH82 | G | mo17 | | | | |
| 453 | Ampli-con1460644 | 148053 | 290 | 290 | SNP | A | b73 | G | mo17:5CM1:LH82 | | | | |
| 453 | Ampli-con1460644 | 148054 | 295 | 295 | SNP | A | mo17:LH82 | G | b73:5CM | | | | |
| 453 | Ampli-con1460644 | 148055 | 308 | 308 | SNP | C | mo17 | T | b73:5CM1:LH82 | | | | |
| 453 | Ampli-con1460644 | 148056 | 325 | 339 | IND | *************** | b73:5CM1 | CCTTCGATGATAATG | mo17 | TCTTCGATGATAATG | LH82 | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 453 | Ampli-con1460644 | 148057 | 342 | 356 | IND | **************** | mo17 | TTCGACGATGACGCC | b73 | TTCGATGATGACGCC | 5CM1 | TTCGATGATG-ATGCC | LH82 |
| 453 | Ampli-con1460644 | 148058 | 359 | 359 | SNP | C | mo17:LH82 | G | b73:5CM1 | | | | |
| 453 | Ampli-con1460644 | 148059 | 360 | 360 | SNP | C | mo17:LH82 | T | b73:5CM1 | | | | |
| 453 | Ampli-con1460644 | 148060 | 367 | 367 | SNP | C | b73:5CM1 | T | mo17:LH82 | | | | |
| 453 | Ampli-con1460644 | 148061 | 372 | 372 | SNP | A | mo17:LH82 | G | b73:5CM1 | | | | |
| 453 | Ampli-con1460644 | 148062 | 375 | 375 | SNP | A | b73:5CM1 | G | mo17:LH82 | | | | |
| 453 | Ampli-con1460644 | 148063 | 378 | 378 | SNP | G | b73:5CM1:LH82 | T | mo17 | | | | |
| 453 | Ampli-con1460644 | 148064 | 382 | 382 | SNP | A | LH82 | C | b73:mo17:5CM1 | | | | |
| 453 | Ampli-con1460644 | 148065 | 384 | 384 | SNP | A | b73:5CM1 | G | mo17:LH82 | | | | |
| 453 | Ampli-con1460644 | 148066 | 393 | 393 | SNP | A | b73:5CM1:LH82 | G | mo17 | | | | |
| 453 | Ampli-con1460644 | 148067 | 399 | 399 | SNP | A | mo17 | G | b73:5CM1:LH82 | | | | |
| 453 | Ampli-con1460644 | 148068 | 424 | 424 | SNP | C | mo17:LH82 | T | b73:5CM1 | | | | |
| 453 | Ampli-con1460644 | 148069 | 432 | 432 | SNP | A | b73 | G | mo17:5CM1:LH82 | | | | |
| 454 | Ampli-con1460702 | 148621 | 441 | 441 | SNP | A | LH82 | G | b73:mo17:5CM1 | | | | |
| 455 | Ampli-con1460724 | 148362 | 274 | 274 | SNP | A | 5CM1 | G | b73:LH82 | | | | |
| 455 | Ampli-con1460724 | 148364 | 425 | 425 | SNP | A | b73:LH82 | C | 5CM1 | | | | |
| 455 | Ampli-con1460724 | 148367 | 548 | 548 | SNP | G | 5CM1 | T | b73:LH82 | | | | |
| 455 | Ampli-con1460724 | 148380 | 600 | 600 | SNP | C | b73:LH82 | G | 5CM1 | | | | |
| 455 | Ampli-con1460724 | 148381 | 601 | 601 | SNP | A | b73:LH82 | T | 5CM1 | | | | |
| 455 | Ampli-con1460724 | 148382 | 605 | 605 | SNP | A | 5CM1 | T | b73:LH82 | | | | |
| 455 | Ampli-con1460724 | 148384 | 618 | 618 | SNP | G | b73:mo17:5CM1 | T | LH82 | | | | |
| 456 | Ampli-con1461863 | 151469 | 54 | 54 | SNP | C | b73:mo17:5CM1 | T | 5CM1 | | | | |
| 456 | Ampli-con1461863 | 151470 | 63 | 63 | SNP | C | b73:mo17:LH82 | T | 5CM1 | | | | |
| 456 | Ampli-con1461863 | 151471 | 69 | 69 | SNP | C | 5CM1 | G | b73:mo17:LH82 | | | | |
| 456 | Ampli-con1461863 | 151472 | 93 | 93 | SNP | A | LH82 | G | b73:mo17:5CM1 | | | | |
| 456 | Ampli-con1461863 | 151473 | 114 | 114 | SNP | C | LH82 | T | b73:mo17:5CM1 | | | | |
| 456 | Ampli-con1461863 | 151474 | 144 | 144 | SNP | A | 5CM1 | G | b73:mo17:LH82 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 456 | Ampli-con1461863 | 151475 | 223 | 228 | IND | ****** | LH82 | TTCGGT | b73:mo17:5CM1 | | | | |
| 456 | Ampli-con1461863 | 151476 | 240 | 240 | SNP | C | b73:mo17:LH82 | T | 5CM1 | | | | |
| 456 | Ampli-con1461863 | 151477 | 249 | 249 | SNP | A | b73:mo17:5CM1 | C | LH82 | | | | |
| 456 | Ampli-con1461863 | 151478 | 253 | 253 | SNP | G | 5CM1 | T | b73:mo17:LH82 | | | | |
| 456 | Ampli-con1461863 | 151479 | 258 | 258 | SNP | A | b73:mo17 | G | 5CM1:LH82 | | | | |
| 456 | Ampli-con1461863 | 151480 | 268 | 270 | IND | *** | b73:mo17:LH82 | GAG | 5CM1 | | | | |
| 456 | Ampli-con1461863 | 151481 | 297 | 297 | SNP | C | b73:mo17:LH82 | T | 5CM1 | | | | |
| 456 | Ampli-con1461863 | 151482 | 318 | 318 | SNP | C | b73:mo17:LH82 | T | 5CM1 | | | | |
| 456 | Ampli-con1461863 | 151483 | 408 | 408 | SNP | A | b73:mo17:LH82 | G | 5CM1 | | | | |
| 456 | Ampli-con1461863 | 151484 | 450 | 450 | SNP | A | 5CM1 | G | b73:mo17:LH82 | | | | |
| 456 | Ampli-con1461863 | 151485 | 459 | 459 | SNP | A | b73:mo17:LH82 | G | 5CM1 | | | | |
| 456 | Ampli-con1461863 | 151486 | 524 | 524 | SNP | C | b73:LH82 | G | 5CM1:LH82 | | | | |
| 457 | Ampli-con1461872 | 151382 | 224 | 224 | SNP | A | 5CM1 | C | b73:LH82 | | | | |
| 457 | Ampli-con1461872 | 151384 | 418 | 418 | SNP | C | b73:LH82 | G | 5CM1 | | | | |
| 457 | Ampli-con1461872 | 151385 | 444 | 444 | SNP | C | b73:LH82 | G | 5CM1 | | | | |
| 457 | Ampli-con1461872 | 151386 | 531 | 531 | SNP | A | b73 | T | 5CM1:LH82 | | | | |
| 457 | Ampli-con1461872 | 151388 | 534 | 534 | IND | * | b73:LH82 | G | 5CM1 | | | | |
| 457 | Ampli-con1461872 | 151389 | 534 | 536 | IND | *** | b73:LH82 | GCG | 5CM1 | | | | |
| 457 | Ampli-con1461872 | 151390 | 539 | 543 | IND | ****** | b73:LH82 | TTGCC | 5CM1 | | | | |
| 457 | Ampli-con1461872 | 151391 | 558 | 559 | IND | ** | LH82 | *A | b73 | GA | 5CM1 | |
| 457 | Ampli-con1461872 | 151392 | 562 | 562 | IND | * | b73 | A | 5CM1:LH82 | | | | |
| 457 | Ampli-con1461872 | 151393 | 568 | 568 | SNP | C | 5CM1 | G | b73:LH82 | | | | |
| 457 | Ampli-con1461872 | 151396 | 638 | 640 | IND | *** | 5CM1 | GGC | b73:LH82 | | | | |
| 457 | Ampli-con1461872 | 151397 | 642 | 642 | IND | * | 5CM1 | T | b73:LH82 | | | | |
| 458 | Ampli-con1461878 | 151271 | 267 | 267 | SNP | C | b73 | T | 5CM1 | | | | |
| 458 | Ampli-con1461878 | 151273 | 398 | 398 | SNP | G | 5CM1 | T | b73 | | | | |
| 458 | Ampli-con1461878 | 151274 | 406 | 406 | SNP | C | b73 | T | 5CM1 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 458 | Ampli-con1461878 | 151276 | 465 | 465 | SNP | C | b73 | T | 5CM1 | | | | |
| 458 | Ampli-con1461878 | 151277 | 468 | 468 | SNP | A | b73 | C | 5CM1 | | | | |
| 458 | Ampli-con1461878 | 151280 | 1079 | 1079 | SNP | A | 5CM1 | G | b73 | | | | |
| 458 | Ampli-con1461878 | 151281 | 1142 | 1144 | IND | *** | 5CM1 | GAG | b73 | | | | |
| 458 | Ampli-con1461878 | 151282 | 1155 | 1155 | SNP | A | b73 | G | 5CM1 | | | | |
| 458 | Ampli-con1461878 | 151283 | 1167 | 1167 | SNP | A | 5CM1 | G | b73 | | | | |
| 458 | Ampli-con1461878 | 151284 | 1180 | 1180 | SNP | A | b73 | G | 5CM1 | | | | |
| 458 | Ampli-con1461878 | 151285 | 1280 | 1280 | SNP | A | 5CM1 | T | b73 | | | | |
| 458 | Ampli-con1461878 | 151287 | 1323 | 1323 | SNP | C | b73 | G | 5CM1 | | | | |
| 458 | Ampli-con1461878 | 151288 | 1419 | 1419 | SNP | A | 5CM1 | T | b73 | | | | |
| 458 | Ampli-con1461878 | 151289 | 1447 | 1447 | SNP | C | 5CM1 | T | b73 | | | | |
| 458 | Ampli-con1461878 | 151290 | 1586 | 1586 | SNP | A | 5CM1 | G | b73 | | | | |
| 459 | Ampli-con1461878 | 151356 | 119 | 119 | SNP | A | LH82 | G | b73:mo17:5CM1 LH82 | | | | |
| 459 | Ampli-con1461887 | 151357 | 200 | 200 | SNP | A | b73:mo17:5CM1 | C | LH82 | | | | |
| 459 | Ampli-con1461887 | 151358 | 201 | 201 | SNP | C | b73:mo17:5CM1 | T | LH82 | | | | |
| 459 | Ampli-con1461887 | 151359 | 420 | 420 | SNP | A | b73:mo17:5CM1 | G | LH82 | | | | |
| 459 | Ampli-con1461887 | 151360 | 621 | 621 | SNP | A | b73 | G | mo17:5CM1:LH82 | | | | |
| 459 | Ampli-con1461887 | 151362 | 642 | 642 | SNP | C | b73:mo17:5CM1 | T | LH82 | | | | |
| 459 | Ampli-con1461887 | 151363 | 644 | 644 | SNP | A | b73:mo17:5CM1 | T | LH82 | | | | |
| 459 | Ampli-con1461887 | 151364 | 645 | 645 | SNP | A | LH82 | C | b73:mo17:5CM1 | | | | |
| 460 | Ampli-con1462250 | 153431 | 205 | 205 | SNP | A | LH82 | G | b73:mo17:5CM1 | | | | |
| 460 | Ampli-con1462250 | 153432 | 325 | 325 | SNP | A | b73:mo17:LH82 | G | 5CM1 | | | | |
| 460 | Ampli-con1462250 | 153433 | 391 | 391 | SNP | A | 5CM1 | G | b73:mo17:LH82 | | | | |
| 460 | Ampli-con1462250 | 153434 | 529 | 529 | SNP | A | 5CM1 | G | b73:LH82 | | | | |
| 461 | Ampli-con1462274 | 153427 | 79 | 79 | SNP | C | mo17:5CM1 | T | LH82 | | | | |
| 462 | Ampli-con1462278 | 153630 | 55 | 55 | SNP | A | b73:5CM1 | T | LH82 | | | | |
| 462 | Ampli-con1462278 | 153631 | 59 | 59 | SNP | C | b73:5CM1 | T | LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 462 | Ampli-con1462278 | 153632 | 103 | 103 | SNP | G | 5CM1:LH82 | T | b73 | | | | |
| 462 | Ampli-con1462278 | 153633 | 141 | 141 | IND | * | b73:LH82 | A | 5CM1 | | | | |
| 462 | Ampli-con1462278 | 153636 | 210 | 210 | SNP | C | b73:5CM1 | T | LH82 | | | | |
| 462 | Ampli-con1462278 | 153637 | 245 | 245 | SNP | G | b73:LH82 | T | 5CM1 | | | | |
| 462 | Ampli-con1462278 | 153638 | 399 | 399 | SNP | C | 5CM1 | T | b73:LH82 | | | | |
| 462 | Ampli-con1462278 | 153639 | 408 | 415 | IND | ******** | 5CM1 | GCCAAGTC | b73:LH82 | | | | |
| 462 | Ampli-con1462278 | 153640 | 418 | 420 | IND | *** | 5CM1 | CAG | b73:LH82 | | | | |
| 462 | Ampli-con1462278 | 153641 | 423 | 427 | IND | ***** | 5CM1 | AGCCA | b73:LH82 | | | | |
| 462 | Ampli-con1462278 | 153642 | 433 | 433 | SNP | A | 5CM1 | C | b73:LH82 | | | | |
| 462 | Ampli-con1462278 | 153643 | 434 | 434 | SNP | C | 5CM1 | G | b73:LH82 | | | | |
| 462 | Ampli-con1462278 | 153644 | 435 | 435 | SNP | A | 5CM1 | T | b73:LH82 | | | | |
| 462 | Ampli-con1462278 | 153645 | 454 | 457 | IND | **** | 5CM1 | ATCA | b73:LH82 | | | | |
| 462 | Ampli-con1462278 | 153646 | 467 | 467 | SNP | A | b73:LH82 | T | 5CM1 | | | | |
| 462 | Ampli-con1462278 | 153647 | 468 | 468 | SNP | C | b73:LH82 | G | 5CM1 | | | | |
| 462 | Ampli-con1462278 | 153648 | 470 | 470 | SNP | C | 5CM1 | G | b73:LH82 | | | | |
| 462 | Ampli-con1462278 | 153649 | 503 | 503 | SNP | A | b73:LH82 | C | 5CM1 | | | | |
| 462 | Ampli-con1462278 | 153650 | 527 | 527 | SNP | A | b73:LH82 | C | 5CM1 | | | | |
| 462 | Ampli-con1462278 | 153651 | 548 | 548 | IND | * | 5CM1 | T | b73:LH82 | | | | |
| 462 | Ampli-con1462278 | 153652 | 672 | 672 | SNP | A | b73:LH82 | G | 5CM1 | | | | |
| 463 | Ampli-con1462297 | 153856 | 137 | 138 | IND | ** | b73:LH82 | AC | 5CM1 | | | | |
| 463 | Ampli-con1462297 | 153857 | 151 | 151 | SNP | A | 5CM1 | T | b73:LH82 | | | | |
| 463 | Ampli-con1462297 | 153858 | 160 | 163 | IND | **** | LH82 | AGCT | b73:5CM1 | | | | |
| 463 | Ampli-con1462297 | 153860 | 197 | 197 | SNP | C | 5CM1:LH82 | T | b73 | | | | |
| 463 | Ampli-con1462297 | 153861 | 201 | 201 | SNP | A | 5CM1:LH82 | G | b73 | | | | |
| 463 | Ampli-con1462297 | 153862 | 207 | 207 | SNP | G | b73:5CM1 | T | LH82 | | | | |
| 463 | Ampli-con1462297 | 153863 | 221 | 221 | SNP | C | b73:LH82 | T | 5CM1 | | | | |
| 463 | Ampli-con1462297 | 153864 | 232 | 232 | SNP | A | 5CM1 | C | b73:LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 463 | Ampli-con1462297 | 153865 | 270 | 276 | IND | ******** | b73:5CM1 | TCTCCCG | LH82 | | | | |
| 463 | Ampli-con1462297 | 153866 | 292 | 292 | SNP | G | 5CM1 | T | b73:LH82 | | | | |
| 463 | Ampli-con1462297 | 153867 | 302 | 303 | IND | ** | b73 | GG | 5CM1:LH82 | | | | |
| 463 | Ampli-con1462297 | 153868 | 303 | 322 | IND | ******************* | 5CM1 | ***CAGAGCATGGTACCGAG | b73 | GGGCAGAGCATGG-TACCGAG | LH82 | | |
| 463 | Ampli-con1462297 | 153869 | 324 | 324 | SNP | C | LH82 | T | b73:5CM1 | | | | |
| 463 | Ampli-con1462297 | 153870 | 334 | 338 | IND | ***** | LH82 | TATGA | b73:5CM1 | | | | |
| 463 | Ampli-con1462297 | 153871 | 374 | 374 | SNP | A | LH82 | G | b73:5CM1 | | | | |
| 463 | Ampli-con1462297 | 153872 | 389 | 389 | SNP | C | b73 | T | 5CM1:LH82 | | | | |
| 463 | Ampli-con1462297 | 153873 | 392 | 392 | SNP | C | 5CM1:LH82 | T | b73:LH82 | | | | |
| 463 | Ampli-con1462297 | 153874 | 411 | 411 | IND | * | b73:LH82 | T | 5CM1 | | | | |
| 463 | Ampli-con1462297 | 153875 | 414 | 414 | IND | * | 5CM1 | C | b73:LH82 | | | | |
| 463 | Ampli-con1462297 | 153876 | 420 | 420 | SNP | A | b73:5CM1 | G | LH82 | | | | |
| 463 | Ampli-con1462297 | 153877 | 443 | 447 | IND | ***** | 5CM1:LH82 | TTAAA | b73 | | | | |
| 463 | Ampli-con1462297 | 153878 | 472 | 472 | SNP | A | 5CM1:LH82 | G | b73 | | | | |
| 463 | Ampli-con1462297 | 153879 | 553 | 553 | SNP | C | 5CM1:LH82 | G | b73 | | | | |
| 463 | Ampli-con1462297 | 153880 | 714 | 714 | SNP | C | 5CM1:LH82 | T | b73 | | | | |
| 463 | Ampli-con1462297 | 153881 | 715 | 715 | SNP | A | 5CM1:LH82 | T | b73 | | | | |
| 464 | Ampli-con1462302 | 153412 | 260 | 260 | SNP | C | 5CM1:LH82 | G | b73 | | | | |
| 464 | Ampli-con1462302 | 153413 | 286 | 286 | SNP | A | 5CM1:LH82 | T | b73 | | | | |
| 464 | Ampli-con1462302 | 153414 | 320 | 320 | SNP | A | b73 | G | 5CM1:LH82 | | | | |
| 464 | Ampli-con1462302 | 153415 | 430 | 430 | SNP | C | b73 | T | 5CM1:LH82 | | | | |
| 464 | Ampli-con1462302 | 153416 | 434 | 434 | SNP | C | b73 | T | 5CM1:LH82 | | | | |
| 464 | Ampli-con1462302 | 153417 | 492 | 492 | SNP | A | b73 | G | 5CM1:LH82 | | | | |
| 464 | Ampli-con1462302 | 153420 | 1001 | 1001 | SNP | A | 5CM1:LH82 | T | b73 | | | | |
| 464 | Ampli-con1462302 | 153423 | 1032 | 1032 | SNP | G | 5CM1:LH82 | T | b73 | | | | |
| 464 | Ampli-con1462302 | 153424 | 1042 | 1042 | SNP | A | b73 | T | 5CM1:LH82 | | | | |
| 464 | Ampli-con1462302 | 153425 | 1493 | 1493 | SNP | A | b73 | T | 5CM1:LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 464 | Ampli-con1462302 | 153426 | 1495 | 1495 | SNP | A | b73 | G | 5CM1:LH82 | | | | |
| 465 | Ampli-con1462306 | 153885 | 53 | 53 | SNP | C | 5CM1:LH82 | T | b73 | | | | |
| 465 | Ampli-con1462306 | 153886 | 86 | 86 | SNP | A | b73 | G | 5CM1:LH82 | | | | |
| 465 | Ampli-con1462306 | 153887 | 311 | 311 | IND | * | b73 | C | 5CM1:LH82 | | | | |
| 465 | Ampli-con1462306 | 153889 | 352 | 352 | SNP | A | b73 | C | 5CM1:LH82 | | | | |
| 465 | Ampli-con1462306 | 153890 | 372 | 372 | IND | * | b73 | T | 5CM1:LH82 | | | | |
| 465 | Ampli-con1462306 | 153891 | 479 | 479 | SNP | A | b73 | G | 5CM1:LH82 | | | | |
| 465 | Ampli-con1462306 | 153892 | 577 | 577 | SNP | C | 5CM1:LH82 | T | b73 | | | | |
| 465 | Ampli-con1462306 | 153893 | 601 | 601 | SNP | G | 5CM1:LH82 | G | b73 | | | | |
| 465 | Ampli-con1462306 | 153894 | 1032 | 1032 | SNP | A | 5CM1:LH82 | T | b73 | | | | |
| 465 | Ampli-con1462306 | 153895 | 1090 | 1090 | SNP | G | b73 | T | 5CM1:LH82 | | | | |
| 465 | Ampli-con1462306 | 153897 | 1166 | 1166 | SNP | C | b73 | G | 5CM1:LH82 | | | | |
| 465 | Ampli-con1462306 | 153898 | 1214 | 1214 | SNP | C | b73 | T | 5CM1:LH82 | | | | |
| 465 | Ampli-con1462306 | 153901 | 1276 | 1276 | SNP | C | b73 | T | 5CM1:LH82 | | | | |
| 465 | Ampli-con1462306 | 153902 | 1297 | 1297 | SNP | G | 5CM1:LH82 | T | b73 | | | | |
| 465 | Ampli-con1462306 | 153903 | 1362 | 1362 | SNP | C | 5CM1:LH82 | T | b73 | | | | |
| 465 | Ampli-con1462306 | 153904 | 1374 | 1374 | SNP | A | 5CM1:LH82 | G | b73 | | | | |
| 465 | Ampli-con1462306 | 153905 | 1380 | 1383 | IND | **** | b73 | ATAT | 5CM1:LH82 | | | | |
| 465 | Ampli-con1462306 | 153906 | 1385 | 1385 | SNP | C | b73 | T | 5CM1:LH82 | | | | |
| 465 | Ampli-con1462306 | 153907 | 1412 | 1412 | SNP | A | 5CM1:LH82 | G | b73 | | | | |
| 465 | Ampli-con1462306 | 153908 | 1414 | 1414 | SNP | A | 5CM1:LH82 | T | b73 | | | | |
| 465 | Ampli-con1462306 | 153909 | 1466 | 1466 | SNP | C | 5CM1:LH82 | T | b73 | | | | |
| 465 | Ampli-con1462306 | 153910 | 1469 | 1469 | SNP | C | b73 | T | 5CM1:LH82 | | | | |
| 465 | Ampli-con1462306 | 153911 | 1516 | 1516 | SNP | C | b73 | G | 5CM1:LH82 | | | | |
| 465 | Ampli-con1462306 | 153912 | 1555 | 1555 | SNP | C | b73 | T | 5CM1:LH82 | | | | |
| 465 | Ampli-con1462306 | 153913 | 1562 | 1562 | SNP | C | 5CM1:LH82 | G | b73 | | | | |
| 465 | Ampli-con1462306 | 153914 | 1567 | 1567 | SNP | C | 5CM1:LH82 | T | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 465 | Ampli-con1462306 | 153915 | 1580 | 1581 | IND | ** | 5CM1:LH82 | AC | b73 | | | | |
| 465 | Ampli-con1462306 | 153916 | 1585 | 1590 | IND | ****** | 5CM1:LH82 | TTATTA | b73 | | | | |
| 465 | Ampli-con1462306 | 153917 | 1597 | 1597 | SNP | A | b73 | C | 5CM1:LH82 | | | | |
| 465 | Ampli-con1462306 | 153918 | 1608 | 1608 | SNP | C | 5CM1:LH82 | T | b73 | | | | |
| 466 | Ampli-con1463332 | 153971 | 33 | 33 | SNP | C | b73:LH82 | T | 5CM1 | | | | |
| 466 | Ampli-con1463332 | 153972 | 108 | 108 | SNP | G | 5CM1 | T | b73:LH82 | | | | |
| 466 | Ampli-con1463332 | 153973 | 110 | 110 | SNP | A | b73:LH82 | C | 5CM1 | | | | |
| 466 | Ampli-con1463332 | 153974 | 116 | 116 | IND | * | b73:LH82 | T | 5CM1 | | | | |
| 466 | Ampli-con1463332 | 153975 | 141 | 141 | SNP | A | b73:LH82 | G | 5CM1 | | | | |
| 466 | Ampli-con1463332 | 153976 | 148 | 148 | IND | * | b73:LH82 | A | 5CM1 | | | | |
| 466 | Ampli-con1463332 | 153977 | 170 | 170 | SNP | C | 5CM1 | G | b73:LH82 | | | | |
| 466 | Ampli-con1463332 | 153978 | 180 | 180 | SNP | A | 5CM1 | G | b73:LH82 | | | | |
| 466 | Ampli-con1463332 | 153979 | 181 | 181 | SNP | C | b73:LH82 | T | 5CM1 | | | | |
| 466 | Ampli-con1463332 | 153980 | 214 | 214 | SNP | C | 5CM1 | T | b73:LH82 | | | | |
| 466 | Ampli-con1463332 | 153981 | 313 | 313 | SNP | A | b73:LH82 | G | 5CM1 | | | | |
| 466 | Ampli-con1463332 | 153982 | 331 | 331 | SNP | C | 5CM1 | G | b73:LH82 | | | | |
| 466 | Ampli-con1463332 | 153985 | 463 | 463 | SNP | A | 5CM1 | C | b73:LH82 | | | | |
| 466 | Ampli-con1463332 | 153987 | 485 | 485 | SNP | C | 5CM1 | T | b73:LH82 | | | | |
| 466 | Ampli-con1463332 | 153993 | 971 | 971 | SNP | C | b73:LH82 | T | 5CM1 | | | | |
| 466 | Ampli-con1463332 | 153994 | 1124 | 1124 | SNP | C | b73:LH82 | T | 5CM1 | | | | |
| 466 | Ampli-con1463332 | 153995 | 1146 | 1146 | SNP | A | 5CM1 | G | b73:LH82 | | | | |
| 466 | Ampli-con1463332 | 153996 | 1178 | 1207 | IND | *********************** | b73:LH82 | GGTCCATGGTGCACTTAGAAA-GAACAGTCT | 5CM1 | | | | |
| 466 | Ampli-con1463332 | 153997 | 1215 | 1215 | SNP | A | b73:LH82 | G | 5CM1 | | | | |
| 466 | Ampli-con1463332 | 153998 | 1289 | 1289 | SNP | A | b73:LH82 | G | 5CM1 | | | | |
| 466 | Ampli-con1463332 | 153999 | 1424 | 1424 | SNP | C | 5CM1 | T | b73:LH82 | | | | |
| 467 | Ampli-con1463341 | 154038 | 65 | 65 | SNP | A | mo17:5CM1: LH82 | G | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 467 | Ampli-con1463341 | 154039 | 76 | 76 | SNP | G | mo17:5CM1:LH82 | T | b73 | | | | |
| 467 | Ampli-con1463341 | 154040 | 78 | 78 | SNP | A | mo17:5CM1:LH82 | G | b73 | | | | |
| 467 | Ampli-con1463341 | 154041 | 98 | 98 | SNP | G | b73:5CM1 | T | mo17:LH82 | | | | |
| 467 | Ampli-con1463341 | 154042 | 163 | 163 | SNP | A | mo17:5CM1:LH82 | T | b73 | | | | |
| 467 | Ampli-con1463341 | 154043 | 168 | 168 | SNP | C | mo17:LH82 | T | b73:5CM1 | | | | |
| 467 | Ampli-con1463341 | 154044 | 177 | 177 | SNP | A | mo17:LH82 | G | b73:5CM1 | | | | |
| 467 | Ampli-con1463341 | 154045 | 179 | 179 | SNP | A | b73:5CM1 | G | mo17:LH82 | | | | |
| 467 | Ampli-con1463341 | 154046 | 184 | 184 | SNP | A | mo17:LH82 | G | b73:5CM1 | | | | |
| 467 | Ampli-con1463341 | 154047 | 187 | 187 | SNP | G | b73:5CM1 | T | mo17:LH82 | | | | |
| 467 | Ampli-con1463341 | 154048 | 192 | 192 | SNP | A | mo17:5CM1:LH82 | G | b73 | | | | |
| 467 | Ampli-con1463341 | 154049 | 236 | 250 | IND | ************ | mo17:LH82 | CCAGAGGCACGCGCC | b73:5CM1 | | | | |
| 467 | Ampli-con1463341 | 154052 | 317 | 318 | IND | ** | 5CM1 | CT | b73:mo17:LH82 | | | | |
| 467 | Ampli-con1463341 | 154053 | 395 | 395 | SNP | A | mo17:LH82 | G | b73:5CM1 | | | | |
| 467 | Ampli-con1463341 | 154054 | 493 | 493 | SNP | A | b73:5CM1 | C | mo17:LH82 | | | | |
| 467 | Ampli-con1463341 | 154055 | 503 | 503 | SNP | A | b73 | C | mo17:5CM1:LH82 | | | | |
| 467 | Ampli-con1463341 | 154056 | 504 | 504 | SNP | C | 5CM1 | G | b73:mo17:LH82 | | | | |
| 467 | Ampli-con1463341 | 154057 | 538 | 538 | SNP | C | mo17:5CM1:LH82 | G | b73 | | | | |
| 467 | Ampli-con1463341 | 154058 | 557 | 557 | SNP | G | mo17:LH82 | T | b73:5CM1 | | | | |
| 467 | Ampli-con1463341 | 154059 | 602 | 602 | SNP | C | b73:mo17:LH82 | T | 5CM1 | | | | |
| 467 | Ampli-con1463341 | 154060 | 606 | 606 | SNP | A | mo17:5CM1:LH82 | G | b73 | | | | |
| 467 | Ampli-con1463341 | 154061 | 679 | 679 | SNP | G | mo17:5CM1:LH82 | T | b73 | | | | |
| 467 | Ampli-con1463341 | 154062 | 681 | 681 | SNP | C | mo17:5CM1:LH82 | T | b73 | | | | |
| 467 | Ampli-con1463341 | 154063 | 682 | 682 | SNP | A | mo17:5CM1:LH82 | G | b73 | | | | |
| 467 | Ampli-con1463341 | 154064 | 683 | 683 | SNP | C | mo17:5CM1:LH82 | G | b73 | | | | |
| 467 | Ampli-con1463341 | 154065 | 684 | 684 | SNP | A | b73 | T | mo17:5CM1:LH82 | | | | |
| 467 | Ampli-con1463341 | 154066 | 687 | 687 | SNP | A | mo17:5CM1:LH82 | G | b73 | | | | |
| 467 | Ampli-con1463341 | 154067 | 688 | 688 | SNP | A | mo17:5CM1:LH82 | C | b73 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 467 | Ampli-con1463341 | 154068 | 690 | 690 | SNP | C | b73 | T | mo17:5CM1: LH82 b73 | | | | |
| 467 | Ampli-con1463341 | 154069 | 691 | 691 | SNP | G | mo17:5CM1: LH82 | T | mo17:5CM1: LH82 b73 | | | | |
| 467 | Ampli-con1463341 | 154070 | 692 | 692 | SNP | A | b73 | T | mo17:5CM1: LH82 b73 | | | | |
| 467 | Ampli-con1463341 | 154071 | 693 | 693 | SNP | C | b73 | G | mo17:5CM1: LH82 b73 | | | | |
| 467 | Ampli-con1463341 | 154072 | 694 | 694 | SNP | G | mo17:5CM1: LH82 | T | mo17:5CM1: LH82 b73 | | | | |
| 467 | Ampli-con1463341 | 154073 | 695 | 695 | SNP | A | b73 | T | mo17:5CM1: LH82 b73 | | | | |
| 467 | Ampli-con1463341 | 154074 | 696 | 696 | SNP | A | mo17:5CM1: LH82 | T | mo17:5CM1: LH82 b73 | | | | |
| 467 | Ampli-con1463341 | 154075 | 697 | 697 | SNP | A | b73 | G | mo17:5CM1: LH82 b73 | | | | |
| 467 | Ampli-con1463341 | 154076 | 698 | 698 | SNP | G | b73 | T | mo17:5CM1: LH82 b73 | | | | |
| 467 | Ampli-con1463341 | 154077 | 699 | 699 | SNP | A | b73 | G | mo17:5CM1: LH82 b73 | | | | |
| 467 | Ampli-con1463341 | 154078 | 700 | 700 | SNP | G | mo17:5CM1: LH82 | T | mo17:5CM1: LH82 b73 | | | | |
| 467 | Ampli-con1463341 | 154079 | 702 | 702 | SNP | A | b73 | G | mo17:5CM1: LH82 b73 | | | | |
| 467 | Ampli-con1463341 | 154080 | 704 | 704 | SNP | G | b73 | T | mo17:5CM1: LH82 b73 | | | | |
| 467 | Ampli-con1463341 | 154081 | 705 | 705 | SNP | A | b73 | T | mo17:5CM1: LH82 b73 | | | | |
| 467 | Ampli-con1463341 | 154082 | 706 | 706 | SNP | G | mo17:5CM1: LH82 | T | mo17:5CM1: LH82 b73 | | | | |
| 467 | Ampli-con1463341 | 154083 | 708 | 708 | SNP | G | mo17:5CM1: LH82 | T | mo17:5CM1: LH82 b73 | | | | |
| 467 | Ampli-con1463341 | 154084 | 709 | 709 | SNP | A | b73 | C | mo17:5CM1: LH82 b73 | | | | |
| 467 | Ampli-con1463341 | 154085 | 711 | 711 | SNP | A | mo17:5CM1: LH82 | G | mo17:5CM1: LH82 b73 | | | | |
| 467 | Ampli-con1463341 | 154086 | 712 | 712 | SNP | A | mo17:5CM1: LH82 | C | b73 | | | | |
| 467 | Ampli-con1463341 | 154087 | 713 | 713 | SNP | A | b73 | C | mo17:5CM1: LH82 b73 | | | | |
| 467 | Ampli-con1463341 | 154088 | 714 | 714 | SNP | A | mo17:5CM1: LH82 | G | mo17:5CM1: LH82 b73 | | | | |
| 467 | Ampli-con1463341 | 154089 | 715 | 715 | SNP | A | mo17:5CM1: LH82 | T | b73 | | | | |
| 467 | Ampli-con1463341 | 154090 | 717 | 717 | SNP | A | b73 | G | mo17:5CM1: LH82 b73 | | | | |
| 467 | Ampli-con1463341 | 154091 | 718 | 718 | SNP | A | b73:mo17: LH82 | G | mo17:5CM1: 5CM1 | | | | |
| 467 | Ampli-con1463341 | 154092 | 719 | 719 | SNP | A | b73 | G | mo17:5CM1: LH82 | | | | |
| 467 | Ampli-con1463341 | 154093 | 720 | 720 | SNP | C | b73 | T | mo17:5CM1: LH82 b73 | | | | |
| 467 | Ampli-con1463341 | 154094 | 721 | 721 | SNP | A | b73 | G | mo17:5CM1: LH82 | | | | |

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 467 | Amplicon1463341 | 154095 | 722 | 722 | SNP | C | mo17:5CM1:LH82 | T | b73 | | | | |
| 467 | Amplicon1463341 | 154096 | 723 | 723 | SNP | A | b73 | T | mo17:5CM1:LH82 | | | | |
| 467 | Amplicon1463341 | 154097 | 724 | 724 | SNP | G | b73 | T | mo17:5CM1:LH82 | | | | |
| 467 | Amplicon1463341 | 154098 | 726 | 726 | SNP | C | b73 | T | mo17:5CM1:LH82 | | | | |
| 467 | Amplicon1463341 | 154099 | 727 | 727 | SNP | A | b73 | T | mo17:5CM1:LH82 | | | | |
| 467 | Amplicon1463341 | 154100 | 728 | 728 | SNP | A | mo17:5CM1:LH82 | C | b73 | | | | |
| 467 | Amplicon1463341 | 154101 | 729 | 729 | SNP | C | mo17:5CM1:LH82 | T | b73 | | | | |
| 468 | Amplicon1463358 | 154007 | 50 | 50 | SNP | A | 5CM1 | G | b73:LH82 | | | | |
| 468 | Amplicon1463358 | 154008 | 73 | 73 | SNP | A | b73:LH82 | G | 5CM1 | | | | |
| 468 | Amplicon1463358 | 154009 | 208 | 208 | SNP | C | 5CM1 | T | b73:LH82 | | | | |
| 468 | Amplicon1463358 | 154010 | 282 | 282 | SNP | C | 5CM1 | T | b73:LH82 | | | | |
| 468 | Amplicon1463358 | 154011 | 292 | 321 | IND | ****************** | b73:LH82 | ACTGTTCTTTCTAAGTGCAC-CATGGACCAG | 5CM1 | | | | |
| 468 | Amplicon1463358 | 154012 | 351 | 351 | SNP | C | b73:LH82 | T | 5CM1 | | | | |
| 468 | Amplicon1463358 | 154013 | 373 | 373 | SNP | A | 5CM1 | G | b73:LH82 | | | | |
| 468 | Amplicon1463358 | 154014 | 526 | 526 | SNP | A | 5CM1 | G | b73:LH82 | | | | |
| 468 | Amplicon1463358 | 154020 | 927 | 927 | SNP | C | b73:LH82 | T | 5CM1 | | | | |
| 468 | Amplicon1463358 | 154021 | 1012 | 1012 | SNP | A | 5CM1 | G | b73:LH82 | | | | |
| 468 | Amplicon1463358 | 154023 | 1034 | 1034 | SNP | G | b73:LH82 | T | 5CM1 | | | | |
| 468 | Amplicon1463358 | 154026 | 1166 | 1166 | SNP | C | 5CM1 | G | b73:LH82 | | | | |
| 468 | Amplicon1463358 | 154027 | 1184 | 1184 | SNP | C | 5CM1 | T | b73:LH82 | | | | |
| 468 | Amplicon1463358 | 154028 | 1283 | 1283 | SNP | A | b73:LH82 | G | 5CM1 | | | | |
| 468 | Amplicon1463358 | 154029 | 1316 | 1316 | SNP | A | 5CM1 | G | b73:LH82 | | | | |
| 468 | Amplicon1463358 | 154030 | 1317 | 1317 | SNP | C | b73:LH82 | T | 5CM1 | | | | |
| 468 | Amplicon1463358 | 154031 | 1327 | 1327 | SNP | C | b73:LH82 | G | 5CM1 | | | | |
| 468 | Amplicon1463358 | 154032 | 1350 | 1350 | IND | * | b73:LH82 | T | 5CM1 | | | | |
| 468 | Amplicon1463358 | 154033 | 1356 | 1356 | SNP | C | 5CM1 | T | b73:LH82 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 468 | Ampli-con1463358 | 154034 | 1383 | 1383 | IND | * | b73:LH82 | A | 5CM1 | | | | |
| 468 | Ampli-con1463358 | 154035 | 1387 | 1387 | SNP | G | 5CM1 | T | b73:LH82 | | | | |
| 468 | Ampli-con1463358 | 154036 | 1389 | 1389 | SNP | A | b73:LH82 | C | 5CM1 | | | | |
| 468 | Ampli-con1463358 | 154037 | 1464 | 1464 | SNP | A | 5CM1 | G | b73:LH82 | | | | |
| 469 | Ampli-con1463815 | 154534 | 64 | 64 | SNP | A | 5CM1 | G | b73:mo17:LH82 5CM1 | | | | |
| 469 | Ampli-con1463815 | 154535 | 100 | 100 | SNP | C | b73:mo17:LH82 | T | 5CM1 | | | | |
| 469 | Ampli-con1463815 | 154536 | 238 | 238 | SNP | C | b73:mo17:LH82 5CM1 | T | 5CM1 | | | | |
| 469 | Ampli-con1463815 | 154537 | 304 | 304 | SNP | C | b73:mo17:LH82 5CM1 | T | b73:mo17:LH82 | | | | |
| 470 | Ampli-con1463828 | 155152 | 30 | 31 | IND | ** | b73:5CM1 | TA | LH82 | | | | |
| 470 | Ampli-con1463828 | 155153 | 83 | 93 | IND | ********** | LH82 | ATATATATACA | b73:5CM1 | | | | |
| 470 | Ampli-con1463828 | 155154 | 158 | 158 | SNP | A | b73:5CM1 | T | LH82 | | | | |
| 470 | Ampli-con1463828 | 155155 | 289 | 289 | SNP | C | LH82 | G | b73:5CM1 | | | | |
| 470 | Ampli-con1463828 | 155156 | 290 | 290 | SNP | A | b73:5CM1 | T | LH82 | | | | |
| 470 | Ampli-con1463828 | 155157 | 338 | 338 | SNP | C | LH82 | T | b73:5CM1 | | | | |
| 470 | Ampli-con1463828 | 155158 | 346 | 346 | SNP | C | LH82 | G | b73:5CM1 | | | | |
| 470 | Ampli-con1463828 | 155159 | 457 | 457 | SNP | A | b73:5CM1 | G | LH82 | | | | |
| 471 | Ampli-con1463835 | 154552 | 194 | 194 | SNP | C | b73:LH82 | C | 5CM1 | | | | |
| 471 | Ampli-con1463835 | 154553 | 271 | 271 | SNP | C | 5CM1 | T | b73:LH82 | | | | |
| 471 | Ampli-con1463835 | 154554 | 276 | 276 | SNP | A | b73:LH82 | G | 5CM1 | | | | |
| 471 | Ampli-con1463835 | 154555 | 330 | 330 | SNP | C | b73:LH82 | T | 5CM1 | | | | |
| 471 | Ampli-con1463835 | 154557 | 388 | 388 | SNP | A | 5CM1 | G | b73:LH82 | | | | |
| 471 | Ampli-con1463835 | 154558 | 395 | 395 | SNP | A | 5CM1 | G | b73:LH82 | | | | |
| 471 | Ampli-con1463835 | 154559 | 433 | 436 | IND | **** | b73:LH82 | AATT | 5CM1 | | | | |
| 471 | Ampli-con1463835 | 154560 | 627 | 627 | IND | * | 5CM1 | G | b73:LH82 | | | | |
| 471 | Ampli-con1463835 | 154561 | 633 | 633 | SNP | C | 5CM1 | T | b73:LH82 | | | | |
| 471 | Ampli-con1463835 | 154562 | 680 | 680 | SNP | C | b73:LH82 | T | 5CM1 | | | | |
| 471 | Ampli-con1463835 | 154563 | 764 | 764 | SNP | A | b73:LH82 | G | 5CM1 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 471 | Ampli-con1463835 | 154564 | 859 | 859 | SNP | A | 5CM1 | T | b73:LH82 | | | | |
| 471 | Ampli-con1463835 | 154565 | 874 | 874 | SNP | C | b73:LH82 | T | 5CM1 | | | | |
| 471 | Ampli-con1463835 | 154567 | 1063 | 1063 | SNP | A | 5CM1 | G | b73:LH82 | | | | |
| 471 | Ampli-con1463835 | 154568 | 1099 | 1099 | SNP | C | b73:LH82 | T | 5CM1 | | | | |
| 471 | Ampli-con1463835 | 154569 | 1237 | 1237 | SNP | C | b73:LH82 | T | 5CM1 | | | | |
| 472 | Ampli-con1463848 | 154530 | 79 | 79 | SNP | A | 5CM1 | G | b73:mo17:LH82 | | | | |
| 472 | Ampli-con1463848 | 154531 | 115 | 115 | SNP | C | b73:mo17:LH82 | T | 5CM1 | | | | |
| 472 | Ampli-con1463848 | 154532 | 253 | 253 | SNP | C | b73:mo17:LH82 | T | 5CM1 | | | | |
| 472 | Ampli-con1463848 | 154533 | 319 | 319 | SNP | C | 5CM1 | T | b73:mo17:LH82 | | | | |
| 473 | Ampli-con1463850 | 154616 | 221 | 221 | SNP | A | b73 | C | 5CM1 | | | | |
| 473 | Ampli-con1463850 | 154617 | 298 | 298 | SNP | C | 5CM1 | T | b73 | | | | |
| 473 | Ampli-con1463850 | 154618 | 303 | 303 | SNP | A | b73 | T | 5CM1 | | | | |
| 473 | Ampli-con1463850 | 154619 | 357 | 357 | SNP | A | b73 | G | 5CM1 | | | | |
| 473 | Ampli-con1463850 | 154621 | 415 | 415 | SNP | A | 5CM1 | G | b73 | | | | |
| 473 | Ampli-con1463850 | 154622 | 422 | 422 | SNP | A | 5CM1 | G | b73 | | | | |
| 473 | Ampli-con1463850 | 154623 | 460 | 461 | IND | ** | b73 | AA | 5CM1 | | | | |
| 473 | Ampli-con1463850 | 154624 | 463 | 463 | IND | * | b73 | T | 5CM1 | | | | |
| 473 | Ampli-con1463850 | 154626 | 609 | 609 | SNP | C | 5CM1 | T | b73 | | | | |
| 473 | Ampli-con1463850 | 154627 | 707 | 707 | SNP | C | 5CM1 | T | b73 | | | | |
| 473 | Ampli-con1463850 | 154628 | 791 | 791 | SNP | A | 5CM1 | G | b73 | | | | |
| 473 | Ampli-con1463850 | 154629 | 886 | 886 | SNP | A | 5CM1 | T | b73 | | | | |
| 473 | Ampli-con1463850 | 154630 | 901 | 901 | SNP | C | 5CM1 | T | b73 | | | | |
| 473 | Ampli-con1463850 | 154632 | 1090 | 1090 | SNP | A | 5CM1 | G | b73 | | | | |
| 473 | Ampli-con1463850 | 154633 | 1126 | 1126 | SNP | C | b73 | T | 5CM1 | | | | |
| 474 | Ampli-con1463853 | 154505 | 131 | 131 | SNP | C | b73:mo17:LH82 | T | 5CM1 | | | | |
| 474 | Ampli-con1463853 | 154506 | 335 | 335 | SNP | C | 5CM1 | T | b73:mo17:LH82 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 475 | Ampli-con1463858 | 154511 | 221 | 221 | SNP | A | b73:LH82 | C | 5CM1 | | | | |
| 475 | Ampli-con1463858 | 154512 | 298 | 298 | SNP | C | 5CM1 | T | b73:LH82 | | | | |
| 475 | Ampli-con1463858 | 154513 | 303 | 303 | SNP | A | Ampli-con1463858 | T | 5CM1 | | | | |
| 475 | Ampli-con1463858 | 154514 | 357 | 357 | SNP | A | b73:LH82 | G | 5CM1 | | | | |
| 475 | Ampli-con1463858 | 154516 | 415 | 415 | SNP | A | 5CM1 | G | b73:LH82 | | | | |
| 475 | Ampli-con1463858 | 154517 | 422 | 422 | SNP | A | 5CM1 | G | b73:LH82 | | | | |
| 475 | Ampli-con1463858 | 154518 | 460 | 464 | IND | **T | LH82 | T** | b73 | AATTT | 5CM1 | | |
| 475 | Ampli-con1463858 | 154519 | 609 | 609 | SNP | C | 5CM1 | T | b73:LH82 | | | | |
| 475 | Ampli-con1463858 | 154520 | 650 | 650 | IND | * | 5CM1 | A | b73:LH82 | | | | |
| 475 | Ampli-con1463858 | 154521 | 654 | 654 | IND | * | 5CM1 | G | b73:LH82 | | | | |
| 475 | Ampli-con1463858 | 154522 | 660 | 660 | SNP | C | 5CM1 | T | b73:LH82 | | | | |
| 475 | Ampli-con1463858 | 154523 | 707 | 707 | SNP | C | b73:LH82 | T | 5CM1 | | | | |
| 475 | Ampli-con1463858 | 154524 | 791 | 791 | SNP | A | b73:LH82 | G | 5CM1 | | | | |
| 475 | Ampli-con1463858 | 154526 | 901 | 901 | SNP | C | b73:LH82 | T | 5CM1 | | | | |
| 475 | Ampli-con1463858 | 154528 | 1090 | 1090 | SNP | A | 5CM1 | G | b73:LH82 | | | | |
| 475 | Ampli-con1463858 | 154529 | 1126 | 1126 | SNP | C | b73:LH82 | T | 5CM1 | | | | |
| 476 | Ampli-con1463864 | 154843 | 93 | 95 | IND | *** | b73:mo17 | CAC | 5CM1 | | | | |
| 476 | Ampli-con1463864 | 154844 | 114 | 114 | IND | * | b73:5CM1 | T | mo17 | | | | |
| 476 | Ampli-con1463864 | 154845 | 169 | 169 | SNP | A | 5CM1 | G | b73:mo17 | | | | |
| 476 | Ampli-con1463864 | 154846 | 251 | 257 | IND | ******** | mo17 | CGGGGCG | b73:5CM1 | | | | |
| 476 | Ampli-con1463864 | 154849 | 289 | 289 | IND | * | mo17:5CM1 | G | b73 | | | | |
| 476 | Ampli-con1463864 | 154853 | 459 | 461 | IND | *** | b73:5CM1 | AAG | mo17 | | | | |
| 476 | Ampli-con1463864 | 154854 | 467 | 467 | SNP | *** | mo17:5CM1 | T | b73 | | | | |
| 476 | Ampli-con1463864 | 154855 | 471 | 471 | SNP | G | 5CM1 | A | b73:mo17 | | | | |
| 476 | Ampli-con1463864 | 154856 | 479 | 479 | SNP | C | b73:5CM1 | T | mo17 | | | | |
| 476 | Ampli-con1463864 | 154857 | 498 | 499 | IND | ** | mo17 | GC | b73:5CM1 | | | | |

-continued

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 476 | Ampli-con1463864 | 154858 | 501 | 501 | IND | * | mo17 | G | b73:5CM1 | | | | |
| 477 | Ampli-con1463878 | 154507 | 62 | 62 | SNP | A | 5CM1 | G | b73:mo17:LH82 | | | | |
| 477 | Ampli-con1463878 | 154508 | 98 | 98 | SNP | C | b73:mo17:LH82 | T | 5CM1 | | | | |
| 477 | Ampli-con1463878 | 154509 | 236 | 236 | SNP | C | b73:mo17:LH82 | T | 5CM1 | | | | |
| 477 | Ampli-con1463878 | 154510 | 302 | 302 | SNP | C | 5CM1 | T | b73:mo17:LH82 | | | | |
| 478 | Ampli-con1464068 | 154475 | 92 | 92 | SNP | A | b73 | T | 5CM1 | | | | |
| 479 | Ampli-con1464087 | 155688 | 97 | 97 | SNP | C | b73:mo17:LH82 | T | 5CM1 | | | | |
| 479 | Ampli-con1464087 | 155689 | 235 | 235 | SNP | C | b73:mo17:LH82 | T | 5CM1 | | | | |
| 479 | Ampli-con1464087 | 155690 | 301 | 301 | SNP | C | 5CM1 | T | b73:LH82 | | | | |
| 480 | Ampli-con1464088 | 155691 | 273 | 273 | SNP | A | 5CM1 | G | b73:mo17:LH82 | | | | |
| 480 | Ampli-con1464088 | 155692 | 309 | 309 | SNP | C | b73:mo17:LH82 | T | 5CM1 | | | | |
| 480 | Ampli-con1464088 | 155696 | 608 | 608 | SNP | C | 5CM1 | T | b73:LH82 | | | | |
| 480 | Ampli-con1464088 | 155697 | 692 | 692 | SNP | A | 5CM1 | G | b73:LH82 | | | | |
| 480 | Ampli-con1464088 | 155702 | 977 | 977 | SNP | C | b73:LH82 | T | 5CM1 | | | | |
| 480 | Ampli-con1464088 | 155703 | 984 | 984 | SNP | C | b73:LH82 | T | 5CM1 | | | | |
| 480 | Ampli-con1464088 | 155705 | 1042 | 1042 | SNP | C | 5CM1 | T | b73:LH82 | | | | |
| 480 | Ampli-con1464088 | 155706 | 1096 | 1096 | SNP | A | 5CM1 | T | b73:LH82 | | | | |
| 480 | Ampli-con1464088 | 155707 | 1101 | 1101 | SNP | A | b73:LH82 | G | 5CM1 | | | | |
| 480 | Ampli-con1464088 | 155708 | 1178 | 1178 | SNP | G | 5CM1 | T | b73:LH82 | | | | |
| 481 | Ampli-con1464097 | 155827 | 341 | 341 | SNP | A | LH82 | T | b73 | | | | |
| 481 | Ampli-con1464097 | 155828 | 347 | 347 | SNP | C | b73 | G | LH82 | | | | |
| 481 | Ampli-con1464097 | 155829 | 417 | 417 | SNP | A | LH82 | G | b73 | | | | |
| 481 | Ampli-con1464097 | 155830 | 484 | 484 | SNP | C | b73 | T | LH82 | | | | |
| 481 | Ampli-con1464097 | 155831 | 510 | 510 | IND | * | b73 | T | LH82 | | | | |
| 481 | Ampli-con1464097 | 155832 | 511 | 511 | IND | * | b73 | A | LH82 | | | | |
| 481 | Ampli-con1464097 | 155833 | 620 | 620 | SNP | C | LH82 | T | b73 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 481 | Ampli-con1464097 | 155835 | 811 | 811 | SNP | C | b73 | T | LH82 | | | | |
| 481 | Ampli-con1464097 | 155836 | 814 | 814 | SNP | C | LH82 | T | b73 | | | | |
| 481 | Ampli-con1464097 | 155837 | 865 | 865 | SNP | A | b73 | G | LH82 | | | | |
| 481 | Ampli-con1464097 | 155838 | 872 | 872 | SNP | A | b73 | G | LH82 | | | | |
| 481 | Ampli-con1464097 | 155839 | 881 | 881 | SNP | C | b73 | T | LH82 | | | | |
| 481 | Ampli-con1464097 | 155840 | 892 | 892 | SNP | A | b73 | C | LH82 | | | | |
| 481 | Ampli-con1464097 | 155841 | 950 | 950 | SNP | A | LH82 | T | b73 | | | | |
| 481 | Ampli-con1464097 | 155842 | 978 | 978 | SNP | G | b73 | T | LH82 | | | | |
| 481 | Ampli-con1464097 | 155843 | 987 | 987 | SNP | A | b73 | G | LH82 | | | | |
| 481 | Ampli-con1464097 | 155844 | 1035 | 1035 | SNP | A | LH82 | G | b73 | | | | |
| 481 | Ampli-con1464097 | 155845 | 1100 | 1100 | SNP | A | b73 | C | LH82 | | | | |
| 481 | Ampli-con1464097 | 155846 | 1133 | 1133 | SNP | C | b73 | T | LH82 | | | | |
| 481 | Ampli-con1464097 | 155848 | 1192 | 1192 | SNP | G | b73 | G | LH82 | | | | |
| 481 | Ampli-con1464097 | 155849 | 1215 | 1215 | SNP | G | b73 | T | LH82 | | | | |
| 481 | Ampli-con1464097 | 155850 | 1239 | 1239 | SNP | A | LH82 | G | b73 | | | | |
| 481 | Ampli-con1464097 | 155851 | 1264 | 1264 | SNP | G | b73 | T | b73 | | | | |
| 481 | Ampli-con1464097 | 155852 | 1265 | 1265 | SNP | C | b73 | G | LH82 | | | | |
| 481 | Ampli-con1464097 | 155853 | 1273 | 1273 | SNP | A | LH82 | T | b73 | | | | |
| 482 | Ampli-con1464098 | 155861 | 117 | 117 | SNP | C | b73:5CM1 | T | mo17:LH82 | | | | |
| 482 | Ampli-con1464098 | 155862 | 138 | 138 | SNP | A | LH82 | C | b73:mo17:5CM1 | | | | |
| 482 | Ampli-con1464098 | 155863 | 148 | 148 | SNP | C | 5CM1 | T | b73:mo17:LH82 | | | | |
| 482 | Ampli-con1464098 | 155864 | 162 | 162 | IND | * | 5CM1 | C | b73:mo17:LH82 | | | | |
| 482 | Ampli-con1464098 | 155865 | 169 | 169 | SNP | A | mo17 | C | b73:5CM1:LH82 | | | | |
| 482 | Ampli-con1464098 | 155866 | 194 | 194 | SNP | A | b73:5CM1 | G | mo17:LH82 | | | | |
| 482 | Ampli-con1464098 | 155867 | 213 | 213 | SNP | A | b73:mo17:5CM1 | C | LH82 | | | | |
| 482 | Ampli-con1464098 | 155868 | 215 | 215 | SNP | A | b73:5CM1 | G | mo17:LH82 | | | | |

-continued

| SEQ_NUM | SEQ_ID | MUTATION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 482 | Ampli-con1464098 | 155869 | 232 | 232 | SNP | A | b73:5CM1 | G | mo17:LH82 | | | | |
| 482 | Ampli-con1464098 | 155870 | 240 | 240 | SNP | C | b73:mo17:5CM1 LH82 | T | LH82 | | | | |
| 482 | Ampli-con1464098 | 155871 | 245 | 245 | SNP | A | LH82 | G | b73:mo17:5CM1 | | | | |
| 482 | Ampli-con1464098 | 155872 | 275 | 275 | SNP | A | b73:5CM1 | G | mo17:LH82 | | | | |
| 482 | Ampli-con1464098 | 155873 | 281 | 281 | SNP | A | b73:5CM1 | G | mo17:LH82 | | | | |
| 482 | Ampli-con1464098 | 155874 | 296 | 296 | SNP | A | b73:5CM1:LH82 | G | mo17 | | | | |
| 482 | Ampli-con1464098 | 155875 | 313 | 313 | SNP | A | b73 | G | mo17:5CM1:LH82 | | | | |
| 482 | Ampli-con1464098 | 155876 | 318 | 318 | SNP | A | mo17:LH82 | G | b73:5CM1 | | | | |
| 482 | Ampli-con1464098 | 155877 | 331 | 331 | SNP | C | mo17 | T | b73:5CM1:LH82 | | | | |
| 482 | Ampli-con1464098 | 155878 | 348 | 362 | IND | ************** | b73:5CM1 | TCTTCGATGATGATAATG | LH82 | | | | |
| 482 | Ampli-con1464098 | 155879 | 370 | 370 | SNP | C | b73 | T | 5CM1:LH82 | | | | |
| 482 | Ampli-con1464098 | 155880 | 376 | 387 | IND | *********** | LH82 | CGCCGAGTATGA | b73:5CM1 | | | | |
| 482 | Ampli-con1464098 | 155881 | 401 | 406 | IND | ****** | b73:5CM1 | GTCACC | mo17:LH82 | | | | |
| 482 | Ampli-con1464098 | 155882 | 414 | 419 | IND | ATGACG | LH82 | ATGCCG | mo17 | | | | |
| 482 | Ampli-con1464098 | 155883 | 428 | 428 | SNP | A | b73:5CM1:LH82 | G | mo17 | | | | |
| 482 | Ampli-con1464098 | 155884 | 434 | 434 | SNP | A | mo17 | G | b73:5CM1:LH82 | | | | |
| 482 | Ampli-con1464098 | 155885 | 534 | 536 | IND | *** | LH82 | CAA | b73:mo17:5CM1 | | | | |
| 482 | Ampli-con1464098 | 155886 | 551 | 551 | SNP | C | b73:mo17 | G | 5CM1:LH82 | C***CA | b73:5CM1 | | |
| 483 | Ampli-con1464112 | 155790 | 40 | 40 | SNP | G | b73:LH82 | T | 5CM1 | | | | |
| 483 | Ampli-con1464112 | 155791 | 72 | 72 | SNP | A | 5CM1 | G | b73:LH82 | | | | |
| 483 | Ampli-con1464112 | 155792 | 78 | 78 | SNP | A | 5CM1 | G | b73:LH82 | | | | |
| 483 | Ampli-con1464112 | 155793 | 132 | 132 | SNP | C | b73:LH82 | T | 5CM1 | | | | |
| 483 | Ampli-con1464112 | 155794 | 151 | 151 | SNP | A | b73:LH82 | G | 5CM1 | | | | |
| 483 | Ampli-con1464112 | 155795 | 161 | 161 | SNP | C | b73:LH82 | T | 5CM1 | | | | |
| 483 | Ampli-con1464112 | 155796 | 241 | 241 | SNP | A | b73:LH82 | G | 5CM1 | | | | |
| 483 | Ampli-con1464112 | 155797 | 252 | 252 | SNP | C | 5CM1 | T | b73:LH82 | | | | |

| SEQ_NUM | SEQ_ID | MUTA-TION_ID | START_POS | END_POS | TYPE | ALLELE1 | STRAINS1 | ALLELE2 | STRAINS2 | ALLELE3 | STRAINS3 | ALLELE4 | STRAINS4 |
|---|---|---|---|---|---|---|---|---|---|---|---|---|---|
| 483 | Ampli-con1464112 | 155798 | 321 | 321 | SNP | C | b73:LH82 | T | 5CM1 | | | | |
| 483 | Ampli-con1464112 | 155799 | 323 | 323 | SNP | C | 5CM1 | T | b73:LH82 | | | | |
| 483 | Ampli-con1464112 | 155800 | 367 | 367 | SNP | A | 5CM1 | T | b73:LH82 | | | | |
| 483 | Ampli-con1464112 | 155801 | 409 | 409 | IND | * | 5CM1 | C | b73:LH82 | | | | |
| 483 | Ampli-con1464112 | 155802 | 413 | 413 | SNP | C | b73:LH82 | G | 5CM1 | | | | |
| 484 | Ampli-con1464142 | 156240 | 92 | 94 | IND | *** | b73 | ATA | 5CM1:LH82 | | | | |
| 484 | Ampli-con1464142 | 156241 | 133 | 133 | SNP | A | LH82 | C | 5CM1 | G | b73 | | |
| 484 | Ampli-con1464142 | 156242 | 214 | 214 | SNP | A | b73 | T | mo17:5CM1:LH82 | | | | |
| 484 | Ampli-con1464142 | 156243 | 247 | 247 | SNP | A | b73 | C | mo17:5CM1:LH82 | | | | |
| 484 | Ampli-con1464142 | 156245 | 286 | 286 | SNP | C | mo17:LH82 | G | 5CM1 | T | b73 | | |
| 484 | Ampli-con1464142 | 156247 | 370 | 370 | SNP | A | mo17:LH82 | G | b73:5CM1 | | | | |
| 484 | Ampli-con1464142 | 156248 | 411 | 411 | SNP | A | b73:LH82 | C | 5CM1 | T | mo17 | | |
| 484 | Ampli-con1464142 | 156249 | 548 | 548 | SNP | A | b73 | C | mo17:LH82 | | | | |
| 484 | Ampli-con1464142 | 156251 | 582 | 582 | SNP | C | mo17:LH82 | T | b73 | | | | |
| 484 | Ampli-con1464142 | 156252 | 593 | 593 | SNP | A | mo17:LH82 | G | b73 | | | | |

SEQUENCE LISTING (2436 sequences)

SEQ ID NO: 1 - DNA, 590 bp, Zea mays
aagagcttcagcaactagagcagcagctggagagttcactgaaacatatcagaaccaggaaggtagtgtgatcatgtatattagactgcagtgcattccttatgtgatgcctactacaccactgacagccttgcgctctgcgcgttggagaaagctaacaagtaaatattcatcgcatgcgcagagccagcttatgctcgagtcaatttcggagctccaacggaaggtaaattcgtcgagcttgcttaaagttggccgttggaacttcctttttaagaactgtaaggtttctttagctgggcattaggtgggcatggtttgttgcaagtattgactgctctggttgtctagttacatccacaaaatattcctgctcttgtgctgtgctgagtattggcatgcgatgcattgccgcaggagaagtcgctgcaggaggagaacaaggttctgcagaaggaggtagccagacgccgctgctcctcaacactcagctagccctctgttttctcatgacgcaaattaaatttacagaaagcgttgctcctgcctgcagctcgcggagaagcagaaagcccagcggaagcaagtgc

SEQ ID NO: 2 - DNA, 458 bp, Zea mays
actaagctgtacatggacagcctcaaggagcccggcgactcggggaagccctactccgcgcggtacatcggcagcctcgtcggcgacttccaccgcactctgctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagaggtatcaaactacttgatcttgaatgtagaactgtgtccagctgatagattaaccagtttgcgtcgtgcagatccaccaaagagtgcctctgtacattgggagcgtggaggaagtggacaaggtggagaaattcctggcttgaatgccagagcctctctcatcagatggactcccgaagacatcaagtttagggagga

SEQ ID NO: 3 - DNA, 650 bp, Zea mays
  misc_feature (205)..(205): n is a, c, g, or t
aagatgggcatttaccgagtggaacataacccattgtgacataaaaaaagaaaaggttagactctttgctcccagtaagaaaacatcagtagctccaattacaacacttttagcagggtatgttacgcagtgagggattgggaggattctaatgtcaactagtgtggaacagtagcgcatatgaactttccaactgaatcctttnaaatcctagttgctataacacatttagcaaacttatgtgaatcctatgagaccctcacatcctgtattattctttctgcattagcctctccacatacccactagctatcactacttcctgaacacagaactatctggctccactactattggacatacatcagttactacctagaatagctagctacactactatattttcaacaagagtcttatattcatcctagtatctatctctctaattactcaccccatcactgttacatttaatcacaatcttatccttcccacctcatatcaatatgctttttcacatacttacctatttctattacatatcaatcgtactattcttacttcagtctatcacacctctttaccaatcatgtataacttaatatacctatctactacttatttactatatctatttcttcatacttatt

SEQ ID NO: 4 - DNA, 330 bp, Zea mays
  misc_feature (119)..(125): n is a, c, g, or t
  misc_feature (224)..(224): n is a, c, g, or t
  misc_feature (239)..(239): n is a, c, g, or t
cccttcctcaaatgtcataaatcgatcaccggaatgacacgcggaacgaattatagaatcttgctatgttatgcttgcacaacaaatcaataaaactcaaacgatggcgcgcaccagannnnnnngcagcgctacagtagccgcagcacaaacagcaatagaaattgctacagtgcttattagataacattacttgcagcagctctgatgttccaccaaaaaanaagttgaggatatanagaactaaacaggctcaccgatctgaaattaccactctaaagcgcacgggatccatccaagagtataattgcctcgtcagaaggttcccaa

SEQ ID NO: 5 - DNA, 200 bp, Zea mays
taacccacaattcacagtcaggcgataaatcctagtctgcggaccataaatcttcttcataaaggtcgtaactctgcctgtcagtcattccaccaaaataagaaaaaaaaatgttcaaacttgcatacaggaaacaaggagtaatgaaaacctgatcatggaacatcgcagacgcggtagcagcaccattagcacgaacc

SEQ ID NO: 6 - DNA, 397 bp, Zea mays
ctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggact

SEQ ID NO: 7 - DNA, 534 bp, Zea mays
caatttataacyaggaatctmttcttctgtttgctctatagccaatgcttgtgttactgctctaaatggtttgctgctgtaagattgggtactracaacaagatccattttttggatgtgcagagccaccttatggccgagtctatttctgagctacagaagaaggtaactaaagctgaaaaaactttcaaggcagttgcactcaggcttrcaaaakaaaacagcacttgagtttgagtggccatttacctgctgatgatttgtggttcagaatgctctgcatctgaacagccatcaacagtagattgatcattgcagaaatgactgttggtactgctgtggtgtgcaggagaggtcactgcaggaggagaacaaggctctgcagaaggaagtaagctgccagagactgactgcaccctaaaccattgcattggcaacagaagggtttgatgtgtgtctcctctttttgtgtagcttgcggagaggcagaaggccgtcgcgagccggcagcagcaggtgcagtgggaccagcag

SEQ ID NO: 8 - DNA, 707 bp, Zea mays
agctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcactttggtacggcttctttcagctcgttcggtctcccaccgagtggtcagttgggaccaacaactggcaatttcggcttcgggatggttcccccaggcatgacgatcccagtgccctctctaggatcacttgcccctgtaaagatggttggaaattcatcagctatgcagggctacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaaaaatgctgaagatgataccctgtcgtgccttgtgtaatcac

SEQ ID NO: 9 - DNA, 822 bp, Zea mays
gtaaattatctgcatgtgtttgccgacaagatgaaggtgattgatttgctacggactttttgattggtgatggatgcatggtctgaagactccgaagcacacgtagaaaacaaagtttgtaactgtatattacactccaggtcccaattcttttgattgtgtggtgtatacattaatacatagcaggaatggaaagaacgatgggtgtgttcctgtcagtcgaaagttgaaacacatacaattgtttctccattgccttaaaactagtattgagatgacgactctgatctgaatttgagcaatctgccaccaaggtttaaagcagcagcaacaacaacagtcttctaattccaaacaagttggagtaggctagaattgaaacctaaccataatttacggttcagacacaatgggtagctcttttttttgtgtgaaattgatttagtactacttgtatatcttcagagatgaggtgaggagagttcctgttctggctgtacatagatattaagatatatttaagtatagaacatgaaccattggctggtcgaaagtcacatgttattcatgcgatatcaaactgccaatgttcagaaacaaggtaaatgtttttgttaaaaaagaaattaagtaaatggtgcttacacatgatgtttcgcatttcaccattcaaacattccaatgtcacaagcatgagtaccgacaacaaaaaagccccgcatgaacccttcaggatgattggttatagtatccatccagagcacaccatagcaaaaaagggttttccgggtgaaaaaataccccacggcaaatcccaatttt

SEQ ID NO: 10 - DNA, 719 bp, Zea mays
ttgcatgcctgcagttgctcgctcgtgacaccaccaccgcgcgctctgacgccagcttcgccacgcggtccattgccagcttttccggtggctatatattactgtgtgtccgaaactagctagcactcacagcctctttgggtgtgtgaggtacgtagatgacttggaacttggaaggtgaatgatgtgtgtggttgctgctcgaaatgttgagcggcttcttgacttttataggctggaaaagactcgcacgtactaaaacgtaaacttagtgtggattattgagatttccttggcttattcacttcttgcacagttgcacggtgcctacttgcgctgtggaataacattctttaatttagactttttctctttgtaggtatgatgattccgggacttgctaagcacatgttaaaaagcacccctccccctcccttctcctttgcaagacgcacacgtatattatattacgaattaaacttcaaattaaaatctttgactttacctaataatttaaattattatggtacaaacttgataagagatagtggataagtgatagtggtgctatcagtgttgtgccattccctaaggtttcattgttggaaatttgtcactccttcgatgccaccctggctgtgttaatgtgtggaggtggttcttgctacatgaagttggagttgccgcgtcagggatatgtctcggtaacgatgataggg

SEQ ID NO: 11 - DNA, 738 bp, Zea mays
ggtgaagctccccacacaacgacaaatactattaacaaggaatgtaagttcgaaaacacaggtcctgaaaattatatcgcttgggaactatcactaaactctggttaagttgctaagaatgtaaggtgatccactcaatttatcactatcacttccttcgctaccaatgtacaatggtcttaaatagtgcaaaggttattttggggatctcatattagatggtgggggcacagaatatgggataatgctacacattctcacttgggaattaaaccttactctcgttaatctgcttttgctatccttatatcagtggccctgtactgttgggctgaacatattgcagtcatcatattgcagacacatgtgatgccagagttttcatgagtaatgtttgcgatcaaggtagttaacaaatatgcatagttgtataatcatgcaactctaatgtctctgccaatatgacaacatttttcattcgccccccagtgtcttatggcacaaaaagttttgtagtgttggccatcaattttgtctgattaggacccatttgttctctatagatatttggctgtaaaatatacatccttggccattatactgataagagtgtagagattacaattgtttcaattttcaaccatacttatacttgtcggaatcatctgatatatttttttatgacaagcttagaaaaattctaggcataggcatgcataaagtgagacctttttgtga

SEQ ID NO: 12 - DNA, 759 bp, Zea mays
aacacgtaacttgcgaataacgaacgagttttgccacagcaggacgatccttgtaccgtcgtccgcaagggttgtaatttctcacggaccgttacgacatgattgtatgtcaggttttgacagtttgagccaatgcaattcttctaatgaaaaagacaagtgcatgtgagtggttagcatctgcctatcgcctatcgggtatcatgtggagtcgtctggtataccgtcctacacggctacacctgagaacgaagcaaccttacccccaacaatcaccttgtagcgatccgaagttgttcatctttgagtttcagttctctaactccatcgtagctaagcgtttcagcaatgagtcaagagagagatttaactatttgtcaccgttaggaaggccacatcttcgtttccttgttttacctggcaactgtacgattttttatcggaaacgctaactggtctattttattgatgtaccatgttaaattagcatgtcacggtggatcttagtcttttttccggagagacacctggaaagtcatttttaccttcgcattttggactatttagtgcgttatgtgcaatttgtttagaattctatcatttagattgcgatatattaatatttaatgcaatactagtagtgtggatttttgggcacttatttgaagtaggatgagctgtggcacagggatacgaaaattaatgagcctcacactatgacacgtagcattaagatacgaaaataaacaacttgatttt

SEQ ID NO: 13 - DNA, 563 bp, Zea mays
atcattttccatgtgaatatacatgcttgtgctgctcatttattcaatacttactcagtcattatgaaaccatttttcttagattactttgttttacatgcagagtcaccgtcagatactgtattgttagtcgatctcattttccagacattgccaatatatgacgatcgagcatcacgaaaagcagtagacgatttggttattcaggctcttggtgaacccaccttcatgaagccctttgctgcggtacttgtacaatctatggaaaagaatctaaaggttacaaacccccttacaagcttaaagcttctcagatggtcacactatcttctgaaatggagtcaatttgccacacttacaaaaggcgcctttaccagactggccaatgcacaagcagtcttatgtcaagtccttatggatgggtccttccgtcggcgccggacttgcaaacagttattcattcatctcttctccgaggtaattattggcaatggtaaataaatttagatcaaatcataattgtctcctacccatatcttatctagttccattttccagcacag

SEQ ID NO: 14 - DNA, 701 bp, Zea mays
tgcatgcctgcagaatccttgggttggaatcgtcaatcgctcacaagcagatattaataggaaggttgacatgatttcagcgagggaaaaagaaagggaatattttgaaacaagtcctgactatgctcatttatcaagtcgtatgggttctggatatcttgctaagcttctttctcaggtaactttaaagctcatttctcggacttatatatatctgagcaaaataacatattcagtaactctattacaacatttcagcatcttgaatctgttatcaaagcacacattcctagtatcacagcgacaatcaacaaaactatagacgaacttgaatcagagctggacatcatagggagagctgtggctgctgatccaggggttagtcagttatatcatatttagacaatcgaaataatcatgactgtattttctctcaatcccctggttctgaattataagtcattccaacttttttggagaatcgaagcatatcaagtttgaccaaatttatataataaaataataatatttatgatattaaataaacgtcattgtattctttattcattatatttttatagtatatctatttaatgtcataattcttcataattctcatataatttttcggcaaccttgagatgctttgaccctctaagagagttggaatgacttataatttgaaatccaggtaatatcag

SEQ ID NO: 15 - DNA, 740 bp, Zea mays
tacccaatgctttcgtatattatcctctcttctcattatttcatatgcacttgcaaaagtggcaaacaatcataatatcatcgctcattaaaaaaacagaaaaactattgcttgtaccatcacatggaaacaatttcaaccaaacatatatcgaggcgttaacagacaaactgattcaaaagaactcaggttggctagtgttctcattgtctcatatacactacaaaattaatagaaatatcaatcaatcatagtgccatcagcttgccaaatcgctgagggtctacagtcataggacagacaatttaaattaggtttctattgaggtataaaattcatcaactaattcagagggagctcatgcacttggagattgaagaacacaccaaagttgccttacaattaggctggtccaaacacagaatttaaatatttcataatcaagtctatccaaccgaagggcaggtctggtgcaggggtgagagttgtctcactgagtcaccaggtcgcgggtttgcagcagcctctccgtatttacagagggaaggcttgcctcggtttatcccttccccaaaccccactcatgtgggaacctccaacacaaggtttgccctttttaatcaagtctattctctattgctccaaatgccaagctttaggtacaaatgtaacacacatgagagggtccaataaaccataatttctgtacaatgtacatagcattaagtttgcacaaataa

SEQ ID NO: 16 - DNA, 749 bp, Zea mays
atagggtaacagaagtcactgagctggaagaatcgcctgggctctcagcctcagccttggatgaggaacccaacgcttgtgttcaagcagtgcttctcagggagccaaactcactaggacacaatcaaagaactgtagttcctagatcacagcatgcatctaatgtactgggtggaaatgagttggtgattgttggacctcgatatgctggttctgtgccacccattgcaacaagaggtctggaaaacagcaaggagagcggtggaaggggcttcaaacccaaaccttgtaacaacattttccaaaatggctcttcaaagcctgaaagggaaccgggcaattcgtcaaacaaaagaacagctggtaaaacggcggaggaccttggtcacaaggatagttcatctgaagtgtcctacgagtactgtgtaagggtggtcaggtggctggagtgcgagggctacatcgagacaaacttcagggtgaagtttctcacatggtttagcctgcgtgccaccccgcaggagagaaagatagtcggtgtctatgtggatacccttattgaggaccctgtcagcctttctggccagctcgttgacagcttctcggaggcggtatatagcaaaaagcggacgcccttctggttttctgcatggacctgtggcattgaaacaccacaagcacctaccgtttgctttgtatggagcacacattcggccccatctttttgtgcagaacgttgcattgattct

SEQ ID NO: 17 - DNA, 810 bp, Zea mays
aaactgaagacttctgtatacgtcttcgcgctcgtcgttgctgttttcatgtacattgtcgttcacatcttgctgtccttcgacaaaatggcacgggtcatgaagaggactggagaacagtgggttccatgtctgaagaagatgtgggcactcattgaaactgaacctccaaaccatcagccatcttcagaggaaccatgagaggctgacccttggctgtatgcttgtattgtgattacatgaattgttcaattgatatgtacctaagtaccttagaatcaatatttgttttccccacttgtttaaggttgaagtgttgtaatctttttatgcacttacagataagatgcattcatccaagagggttagcttcaagtacttcgttcttggttttaactttctcagtatattggacggccggaactacttatttgtagctacctctagcagtctttctctttattctgtaaatagtgcagtctaaagtgtataatagtacaaaatagtgttttctatggtcatatacacgatctactggccacaacctaaggtgggcaagttccgtttgaagaaaaggggagccgtttgagatgacaatatgatctgaattttacactatagagtttaatgattagatcgtggtaggatcgcgctttatttctatttcatttttaactaaaacttatttaaggttctaaaaaaattgggaaaaaaacattttgaattgcaatccattaatgggccggtttgttttcacgtcgggaacccaagttgaccagcctcttggcccttgtaaaactttttttttcg

SEQ ID NO: 18 - DNA, 763 bp, Zea mays
atcatcaggattctccaataccgccacgacagctgccgccgccccatcggcctcctcctcccgccggttcgacccgccgccaccgtcgtcgtcgtcctcctcgagccatcaccaccaccaccaccgccgctgagaatcgaagaagccacactgtaaatctgccgggaagcggctggtggcatccggcccgctcctccctccgggcgccgcaacttttttcgatcggttttgcgccgcccgggacgggttgtagttgatcgattggattcttcataactgtatttgcgtactgcttacactacccaagtgaaatcgaaaatggcgccttctctcgttgaataaattgcacgtacgctactcgatccgctgcggctcttgctggagtggccgccgccgctatagatagaaggatcaagccaaggaatctgtcatgcatggccatgtgaaggaggagcctcctgcaatgtttagtcttttttggtcgacgcccaccagagatatacgcactagattttcatatagctgagctagatcgatcgattccgttgcatgcatgctccatgccgtcgagattcgagctagcaccgcctgttcatcatcgaccgatccattctgatcgattcccctctcgagctttcacgaactgaacctacctagtgagggtgacgcctaacgcctagtgcgcgctgcgtgggtctccgatgtcagtggccgcacgcgcgcgcgcgttctcgagatcgcatgtgcttatagcgcagcaggt

SEQ ID NO: 19 - DNA, 716 bp, Zea mays
acagcgacgacccatcaaagattcttcccaggccgtacatttgctgacgcagaaattgggggaaggccaggtcagcgcccaaaaccagtgagtgtctacgacgctggcccggtggccccaggattctagaatcaaagcagctaaacctaaaattaactcaacgttacaaaactacaaccttctgccctataattctggaatcaaagcaagtaaacctaaaattcctgtggtaccatcgatcctgaaaattgcaaggttccaataccccgacgtcaagagcagcccaaggtatgctcaattcacccatagcattacagctgatctcgtaagactccagcttctacaggtttagcaatatgtccaaccaaggagtgcaggcacaatttccgaaccctgcaaaaggcaagacattagacaaagacaaacgatggaaaaattacaatgaatagcacatggggaagagaaacgtcaattcaactaaagcatctaccactgaaatcaaggccaataaatggttgacatgatatatcagcaatgtaaaccaaaaaaaaaaagacaaaccatgctcataaacgtaaggtcaacacaaccaaatttccagaattattgaagacaaaaaaaaagagaaggaactgaccaactgatcacgcgcttatgtcttgggaactgtaacattcaagatttttacatcttgatatggcttgtcattcttgtca

SEQ ID NO: 20 - DNA, 572 bp, Zea mays
gtcgacctgcagctcggtgtcggcctgcaccgactcgtccgacgggtagtacgtggccacgtaggcgccgcaccaccgcgtgatggccgaccagaggagcagcccgtcggtggcgtacgggtagtcctcgatgagcagccgcagaccgtgcggcttcgtcgggtcctccacggccattcctctgtgacaagggaacacacaccatgtcagcctgcggctcgtacttccgattttaatttccattccaggtgtttttgtgtaccttctgatgagatcggcggggaggccctcctggtcgagccgccagagctcccggtacgcgaacgagctcatctccatgcagtagcggccaggggtgaacccggactcgatgacgccgtcgccgttgatgaggatctgccgcgccagcgcgttgatcttgagcgtgtagcgcatgtgcggcttgagcagcttgaagatggggtgcatcgcgctcagctgccggtgcgccgcgatgatgaacggctccatgcacgcgtgcgtcctcagcctgcacacgcatgcagcgcaatgattagtcgaatccaacaacg

SEQ ID NO: 21 - DNA, 674 bp, Zea mays
agctcgcggttctgctcggccagcctgtcacgcatcgcctgcgactcctccagcagcgaggcgtgcgagagcgccacggccacctggtcggcgaccacctccacgatctccagctcgtgcggcgcccacttcctgccgctgggcggcaccagaaccagcacggcgtagctggccttgatcacctggggcgtcccacccttgaagtcggctaccctgagcatcggcattcggatcgccgccaccgtgccggtcccctccttgccgccgccgctggcggagccaagtaccgagcccggcggcagcagcttgaccccgtcggcgcccttgacctcgaggacgtccgcgtcgtcagcgcccactacggcctcgccgtcgtcgctgccccgccggagctcgtgtgtgaggcacattccggacttgtcctcggatggcatccagacggcgcagttgtcgagcgcgagcaccctggagagctcgatgagcgtggtgtagagcacggtgtggcggtccagcgagcggcggatctcctgggtgagcatgcggacgtgccagctcgcctcctcctgccgcttcatgagcaccacctcgcggtccagctcgcgggccttgatccacagcaggctctcgcggaccttgacgcgcagcagttgcgggatgagcgtgagcagcgtgat

SEQ ID NO: 22 - DNA, 1384 bp, Zea mays
acccagtgtaggtgaagctttctcaagttctgtcttcaagccctgtacaaagaaaatgtgaatgattaaaatatttcatcttatgaaaattcagaaggaagtctgtagaaactaatgtgactggacatgacaagcaatattctattttactctccctttcccctcaatacccacatggaagaaacaagaacagcacaaaatgcaacagcacccaactccttcaatgcatcaataacaaaaaaaaggttcttggaggtgattgatcgtgtcactttcattttaggaaagaacggaggaggctggttatatttgcaggttattaactagattgtctaacttcacttttacaaatttaaagtttcagatatatatacctgaaaaaacatgctataaaacttgggatacaacatagcatgggagcggcacaacattacttacatgcttaattccctcatgaagatggttcacatcttgagatatatgacacttaagggaatatactgattctgtctccatgctctcctcaccactttctgcacagtggaccctggaaaaaaagcattcatcaacaaatatcacaagttcacggcgatcatttcatatttgttacatacttacatgaacacccaatctaccagttgttatgacaaataccaaatggaaacagaaggactgtttggtttgttgcctaacttgccacactttaactaactttttctgcctaaggttagttcttcaatacgagcgactaactttagccaaagtgtggcacagttagccgcgaacagaacaggcacagaatacggaacacctacacaacaattactcgatgacagcactaaaacaatcataagttcataacaggctttacaggcacagacgcccatgtatttgatatgcagacatcaaaagtataggaggtgcagtttgtatcatttaccgttctggacatgcattgggaaataatgtttattgtattcagctaacaattaggtaaaggccaattataaacataaaataagatactgttgtatgttggaactgtctgtgtactgtttaagatatataaaacaggataactagccttatgtcagtatagcagggttctttttggtgtgtgtctaattagcacatggcacatctcacataatcttttgctggtttgaactggacctgtaccatatttttcttctataattatatgctattctatgcacctctcctgcctgttcgagtaaaaaataaacagtcgcaccaaactacaattgtagaacaaaaagtaacatatacatatatagggcatataatacaagggaggggggacagaacctgctcacgagatctatccctaatagtgtatcatcggaagagctgcaggcatgca

SEQ ID NO: 23 - DNA, 832 bp, Zea mays
acaccgcaggtgctatatagtcgacctgcagagccgtgaaggcccgagaagttacaccgtaccaaactgtcctgtggtcactaacaataatcgatagaatggtaaaacatggccgagatggcctgtgtggatctgtgttgaaaacaatccaaatttcactctgacagaatggcggggaaggccagggagcacgtcagcaagttccattccatgatagatatcggagacaagattaccggcttttacagttggagttgacttggcttttaaagcagtccaaaaactctctcgatctgttatagagtgacagtggtccagatgatagagagaagaagcacacggtgcatgcatgatacgacctcccggcctgaccagattgccaacctaccgagtttgacctgaatgcccccggccggtaccatccaaacaccccactgtagacgacgactgtagcgagctagcgacacagacagaggtgcacagtcgtcgtcgtcgcactcgcacgtacggcggaacagaaaccacgacgcgcgctagctgctgcatgcgatgccagggagaaagagagaagaaaaactaggccttggattctagcaatctatagctaccggcacgatctgcatgctagtcgccacgccagggcaagataaccgcgtagtaaaacccgcgttgtacgggcggcggccgcgacaggacaagcggcgcccgcgcgggcaagaggccccgccaggcccacccaactagcctgcttgccgggggtgcccagggccctaagcttaggttaaaccctaacgtaccaggtacaagcttctttttttctttcttacaattg

SEQ ID NO: 24 - DNA, 774 bp, Zea mays
ttgcatgcctgcagcagaacgcgctgtccggcccgataccgcgcggcctcgccggcttggcgagcctccaggcgctcgcgctcgccggcaaccagctcacgggcgcgataccgccggagctcgggacgctcgcggggctccagaagctcaaccttgggaacaactcgctggtgggcgccataccgccggagctcggcgcgctcggcgagctccagtacctcaacctcatgaataatcgcctcaccggccgcgtcccgcgcacgctcgccgcgctctcgcgcgtgcacacgatcgacctgtccggcaacatgctctctggtgcgctgcccgccgagctcggccgcctgccgcagcttactttcttggtgctatccgacaaccaactcaccggcagcgtccccggcgacctgtgcggcggcgatgaagcggagtccagtagcatcgagcaccttatgctctcgatgaacaacttcaccggggagataccggaggggctctcgcggtgccgagcgctgacacagctcggcctggcgaacaacagcctctccggcgttatccccgccgcgctcggcgagctcggcaacctgacggatctggtccttaacaacaacagcctctccggcgagctgccgccagagctcttcaacctcactgagctccagacactggcattgtatcacaacaagctctccggtcgcctgccggacgccatcggccgtcttgtgaacctggaggagctgtacctgtacgagaaccagttcaccggcgagatac

SEQ ID NO: 25 - DNA, 749 bp, Zea mays
ggatcctctatagtctacctgcagtctgcgcacacccaaaccaccccgccacacaaagagcgaaaccctctttctctgcccctcagtcaccgccgcgaacttgcgtcttgcgatcgagggaggaacccaccaaatggctcgcgtggagaggcagccgcggaaccctagtaggctcgcccccacctcccacccggcgccggcgcctccgacgacgccggctgctcgccgccccggcacgccacggaacgctgcccaggtgatcggacctttccttcctctctgcgcgaccgctttgcttttcctcaaatcgtcctgccgatcgcggttcccttcggtggggttttgttggggtgaagtgaaatgcgatgcttttttttttcctgggatgctcttctggctctctgtttgccgtgcgggggttttgtgttcgcgcttgcttgtgcgggggacaatgaggaaatattttattttaaacctgttatgacttttttggttgttcctcaatcctcatgatccctcgcctatagtttgcgcaatgccacctggctttgtaatgttgtcatgtcctgcctgtcctgtactgggtgtactaataactactggtggggttttgatgccagtggctcaccgaaatttgtgctgtttttttaatcttttaaagctagtttggtaaatctatttttttcgaggaattctaattttcctaaagaaaaataaactaatttttcttgtaaaaatggaaatcactt

SEQ ID NO: 26 - DNA, 627 bp, Zea mays
attttatgagctattttatgagctagaattggtctttacgatttgcttggatcttgtaagtagctttctccttctcaaaaaggaaaaaacatttccccttttcccattgaaatggattccttctttccttttccttttgcattgacttttcttttcaaaatcatatattcggtttcgttcatagtttttctatacactatactaatacaaagagacaattccttatttgacactagtaaagttcttggttcatttcttgacctttaaaatataaatcttctatatttaacaatgtatgtaaatttagttcactacattatattaacttttatgtgaaaaatatgagtttactcctatttaatattatcccaataattatcagtgacaaatttggtcatttttatggctcccacctatccactttaatctatcgtggtcttttgtgatcattgttgtctggtgataatccttagtatattgactttgtgaagggcacatctgagtgtccaattttttatgtctaatcttggttctcttcgttattttcttgggatcgaggtctcctccacgcctgaaggcttctatctatctcaaaaagtacattcagaggcttcatgattaatgctc

SEQ ID NO: 27 - DNA, 806 bp, Zea mays
ttttcttcctatatatcagcaggtatttatttgtgaattttcatttataatggtgtacgcatatttaaatttcgagtgtaaggaagtgcagcacaaggttaattttcaggcatgacgacatctgacacatttctattgagctccagggtttaattagtgggtcggccgagacaaaagaacaggcagctgaaggtctaggagagttaattgacgtaacaagtgagaagactcttaaggaagttgtagtgccaattacagggtatgtgttttatccttttgaaattgcttcagttttgtgattgcccttttgaatggttcacatatgaggatttgtgctgtttgaggaaagcccaacatcattgcaaccatgaggcatcccaccacatgtccagctgacagccgaacagctccttaagatctcaaccgttggatttgtggccatagaagaagggatcgagtccggaacgatgatatacatgataggataggggtaacactaaatcactaattaaagaaaatcttgttcaacattggttgagatggtttggatatgttcaatggagacctcttagagatattagtgggatcctaaggcgtgatagctattgaaaagggcaggggaagatcgaagttgacatgaggacaaacattcaaaggagacttgaaatgatggaatatagccaaagattttaccttgaatagaagtgctggaaaacagatatacacatacctgaaccttgacttgtggcttctgggatttaactctagtctaccccaacttgcctgggactaaaaggctttgttgt

SEQ ID NO: 28 - DNA, 765 bp, Zea mays
cggctgtaggtgttgaccactccactcgctcttccgtacctgggcacaagctacgctcacaggcaggtcgctgcacccttccctactccacaatgcaaaacactagcagagccatggccaaatcgaccaatcggggatgactggcaggagacggcactgccaaatcaattaatgagcatgccaaagaggggcaggacagtggctagcggaggctggatgctggaatggcggcatggctggaacctgtgtgcagagcaccgtgcttgtgctgttgtgtacatggacgatcgtcagccaacgttggagagcatggcagcaccagcactccaacaggtaatagaattccccattccaaaatatctattactacccattcatgtggtgatgccagttgtgagcacagccagtggccgagcgtgacacaaactgaagaggaggacaaataactgatttttttctactgtggtcatatagttagctactacaaaaattaggaataaacaattaaccttctctatgaaaaaaatagataatctcagcttactagcatgatatagcactaggattggctaacttgcattgcatgcatctagttcttcagggttattacaagtttccaaacaaggaaaatgacaaaggaacatgcaacgtatcagatacaagaaaaaaaatctgctgagaacgctatgtcctgcattacaaatggagctggtggtttggttatattataatgttatatgctttctactaatgggtcactgaatt

SEQ ID NO: 29 - DNA, 1448 bp, Zea mays
ggatcctctatagtcgtcctgcagctgcacacatactagccttgtgaatgatgggcggcggtattttcataacatgactcatgtatacagtataagccctaggattgagcattatggttgtatggttgacctgttgagtcgtgcgggattgctggaggaggctcatcagctgattggtgacatgccaatgctggcaaatgccgttgtatggggagcacgcctcggtggttgcaagatccatcggaatgctgaccttgctgaatatgtgctgaagcagctcatccgactggagccatggaattctgggaactatgtcatgctttctaacatttactcgaacagtggaagatgggaagatgctgcaaagcttatgttggaaatgaaggcaaaggggattgagaaggtcgctgcctctagctgggttgagcttgatgataaggtccacaagttctatgttggggacgattcacatcctctttcagataagatctatgcaaagcttgatgaattgggccacggcataccttgtagattgagcccatagcagcccatatttgaagaaaaaacaaaagaaaaagagcccaacacgtaacaagcaacatctcgcattgattttgaagcgtgagaatctggtctgcttattctgttcgctgtgtttttttcgttccactcagcttttcgcagccgccgttttacgttagccaattctgctgtcagcttgccgctgtccgctcgtcctttgagctttggtaggtactaacttgaatactagatgcatgcttctttgattcaccaccatttatcatcagaatgtcataatattgtaggtccaaattatcgtctctagtagaacaacgccggtaaattatgtcaatcatgcaacaaccgccgtgcttactattttttttactttaagtatatataatcttaggaaatactgttgtcctaccatgaatagcgctctggtgactagctaaacatgctattagaatataataaataatatatcgatctactatatctatatgtgtgcaatctgttttatatatattttagattacatatatttaaactatacttatattgtattctgtgctggtttgtcaggttgtgtctcccaaatatcttgcctttttgttgcattggactcttctgtggttagaatggcagcacccaagcccatttctcgtcttatttctcacgtcattcttgatttggatggcaccctcttaaacacaggtgacttaaaacttggaaacaactatgattaatggttttttgaggtttagtgtactgaattcacctatctgagctgacttcgattctcttgtcgactctatgtggcagattctgttgtaagtaaggtagtaaaaccatttattctaaagaatggaaaaacgtgggatagcaagaaagctcacaagctagttgggaagacaccttatgaa

SEQ ID NO: 30 - DNA, 709 bp, Zea mays
acaatataacaagttagcgacacaagttttgtacttcaagtcttttaactatatgttggtgcaataagattatgagtaatccatatgaaggtgttgcaagcgaatatgaaaggcaaagataaacggatgaacccattactagctttggctgtatcagaccaataacttgaaatgcacttgtgctagcatgcctaagtattagaaaaggtagcatgggagaatctatattattttggctaacttctttagttactattgattgatgagaaagcctaccattgcccatgccagccctaatgtcccggtgacatgattgagccagtactatgattaatttactctattgttctccttttttgagtgctgtataagatgtcctttttttgagccactcgagaagatgtttacttaactctagtgcgcaatgattggagctctcagtgcaacgcatgtgctctgtaatctactgtcaccactaccctgtagtgtgtgcttaaactctaaactattccacgtggctagtaattaccaatcatttacaacactgttacatgtgtagggctgcgatgcttcggtgctgttggacaacagcagcagcatagttagtgagaaagggtccaacccgaacaggaactccctcaaggggtgggaggcgatcgaccacataaaggctggtcttgaagctgactggccaggcacaagattctgt

SEQ ID NO: 31 - DNA, 782 bp, Zea mays
atggccgcgggctgcgacgacgtgcactcgccgtggaggaactgcatcatcttggacggggtcgtgggcggcgtgggcgtcgacgacgacgacgcctgctgcttgttgtcttgctgcggcgccgtgacgacgccgcgggagggcgtcgagcgcgccgaggcgggatgcccgtggccgccgtcgtcgatgccggtgcgcttgtacacgcggcagagggatatttcggtctgaagcaatgcgaattcggcatgaattatccagatggcatgcatcatgctaataataaagctgagcgacgaaagaacaagtgcgagagcatgaatgggtataactagctagctagttattagagggggatcagaattcagaagtaccttgctaggaacaaactgcctagcctggctcgaatcggaaagccagaaacggagatgctacgagatgatacaattttagtccagatctcagtgattacatctaggatcgtgggatctaggttcacaaactctcgtgcatctaggggagtgtataatcgacagatagcatctaggcgtgtgctgtgaggccaactatatgaacagctagcgtcattgctcatgggcgcatggaaggaagagagggaagatgaacaaaccctaatttatacctagtagtttctcagagaacgaaggcgcttgctccattcaagggaaaaacctagctaacagcaaaaactaactcacccaaagcaagtaagcccaaaccctagctcgttcctatagctaacgactcatcgatttggtggc

SEQ ID NO: 32 - DNA, 691 bp, Zea mays
aggatccttgacgatcttgctcctcctcatctgcttcctcacccgcacagcccttccatgccgtcccttggacgcgtacatgttcgacaagagcacgtggtccccggcctcgccaccgccgctgtccgccgccaccacgacgcgccgcatcacccgctcggctctctcgacgttgccgcgcgcgcggcaggccgcgaggagggaacctcggacgagcgcgtcgggtggcacgggcatcgccgcggcgagcgcctccgcctcgtccagcctccccgcgcggccgagcatgtcgatggcgcacccgtagtgctcgatgccaggcgccacgccgtaggcctccgccatggcgccgaggtgatggaggccctcgtcgacgagcccggcgtggcagcaagcggagaggacgccgaggagcgtcacgccgttcggccgcacgccggttcgccgcatggccgcgaatagcgctagggcctcctcggcgcggccgtgggtggccaaccccgcgatcatcgacccgtaggtgtacacgtcgcgcagcgccatgccgtcgaacactatcatggcctggtccaccgcgccacacttggcgtacatgtagagcagggcgttactaacaacgccgccggcgtcggcgtgacgctcccagctgccggcgcatgtacgcgtgcacccaccgttcggtgttcagagc

SEQ ID NO: 33 - DNA, 801 bp, Zea mays
catgcctgcagcggcgagggtcgtgcccatggcatcggcactggcgggacgcggaaggctggtggcgcgtgcagcagttacagttgcgtgacattgctcttctgatttttgtcagtcctttttttggtcgcaacacacattggctgtcctgaattattttctccttgtgtgttctcttgcgcaggcaaaggcggatgtgccatcgagcacgtccgacgggtaagaacgttttactccctgtctatggcatccatgtgacctgagcccgggacatacgcctgagatgctccacttttcatatctgagattttcatatgtttgctgattttttgtcttcaatcactagtgcacacacatgccccaaccacaaaaggaaaatatgagtggactaagcagcaaagtgtggttttgagcatggatttctaattcggctacaataataaatgaatactcactggttgtagatatctctaggttatgtaactatatgttgtaagattttattatggtacatgaggccgtcaccattgaattgattgcaagatgaaatttggcaccgaacttgctgttttgaatgggttaccaacctgaagtaattacagtagtctggaaaatgagtatttcatccttgtgcctttgcttgcttaaatgaatctagttggcaaaataaatctggagacataatattcagttttattgtagttggtacttggcagcgctggatcgggcaccagttctcatcatttattgtccaagaagtgaactcgttgataaaaataacagatcttaagagatttatat

SEQ ID NO: 34 - DNA, 749 bp, Zea mays
attgttgagatgaaggtgatgaaggcgacgaactcggcgacgacggcccatggcacggtgaagtagttgcgctgcacgtccgcccacatcatgaagagcgggtgctggctccgctcccgcagcttgttcagcgtcacgcccaggtagctcttctccagctccgccgccgcctcgctcgccgcgcccacatgcttgaagaaccgcgcgatgtcctccttgctctcgctcccggcggactgcaccacctccgctgccaccagcacgcccgcgtcctccggcaactgcaccagcttcgccatgagccacacgtacgccgacacgtccccggcgcgctggtccgccgactgctcgaatgccatcaggttcagcagcagcggcgccgtccggaagtcgatccgtagctgcggcaggtgcagccggtcctcgtgcgccagcttcacggccagcggcacagggcccagcaccgacgcgatgccggccggggccttgcccgtgctgccgccgcgcgccttcttgaaccgcacccacattcgcttcaggtcgctcgctgacggcaggtcctcccgcccgtagctcgcgcgccaccggctatcctcgggcaggatcgggtacagcagcggcaccaggagcagcagcgggaggcgccgcagcagccgcgctgtctcctgcatcatctccagcgccgccgcgttctggtgccgctgccgcgggctccacctggtgcgcgccgcggtgaccatcgcgtggag

SEQ ID NO: 35 - DNA, 802 bp, Zea mays
ttccatcatctcctttgcacggatcagcttctcgatttgcctcacgatctgggaagaaaaattacacgagaatgtgcccagtgttaaaatcagttgtattcagaagttacaaggtgctgtgcctaattgtccaagataaagacatgtggtctgcaaagaaataaaatgtcactgacttacttcaaggaccatgtcctcaagcgtcaccaagtcaatgctactgtacccccgctgagaagccacatctgaaaggtgttgaggcatctcagaaaaagttcacccgattatattcaccatttactaaaggggtgtttgttcccctaactaaagtctgtgtcatattgaatgtttgaatgccaattacaagtattaaatatggtctaactataaaactaattccatagatgaagactaaacgacgagacaaattcattaagcctaatgactccatgattagcaaatgtttattgtagcatcacatggacgaataatagtctaatcaggcctaattgactcatcttaccgtttagtccttatctttagtctttatctgtgtaattaattttgtaattatactatatttaaaaattctaactagtattcaaacatttgatctaacgggactaaaatttagtcaggtggctccaaatgagcactaactataactcaacccaaatgagcactaactataactcaacgggaaggacaggcggtttgaggatctatctttactttgtactgaaacagtaatatcagaaaccccatagcgctctatcagttcatcataccgctgacggagctt

SEQ ID NO: 36 - DNA, 754 bp, Zea mays
aaaaaggacgaacattgaccagatttaaccttgaagttgcagacatcagaatagactgacagcttctcgggatatgtgggatgagagctttcaagtcaacttcgcagcggtaggatagaagtaggtcagcctggcaactaaagattggtatattagtaacttcttcaaaaaggaacttgcgtgatgaacattgtaattaatacacaataggtgtggattctgatgtacatcacttcaaaaaatgttgtactccctccctcaaccttctaaggcatattttgatgcaaaaaaagttgtaattttgaccaactgttgtcaaattaaatgtatgttttgaagtcatattaatacattcataattttgaagtgttttgtagtaattgaaaatatactgtgaaaagaattcaaaggttcaaatatgattttgaaaactttacataccaaagtatactctacaataataaacagaaggctcatatggcaatgcagctttaaataaagtgtcaccagatatgtaaagtatgatctccaagtctttaaaatggtacaaatcaaattgttttcgagtcaagagtcaagtcatgcaactactgactagacgaccagtcgtggctagtcgaatataggtcgaagattatattttttataattttctatatatgctaatactaaaaacacgctaaaacactaaaaacaccttgtttagtatatcttcatccatttttattttctaccatatatcattaaattattg

SEQ ID NO: 37 - DNA, 569 bp, Zea mays
atcccaacagaaaattaagttatagatatactgacagttataccgtacaaagaaggatcttttctattaagtcaacataaaattcaaaaatattactaaatgtcaacataaaattcaaaaatattactaaatgtcaacataaaattcaaaatattaaaattcattactattagaagtataacaaatggtgcaaggatagtgtcaatttaaactaggcaaagtatataattgatcagatagtagaaattcaagacgtgtatacatatgcagatcagacaacattcggatagtataccacagtatgtacagtcaatatgcgctagtctctacacaaactcaagtggcagaatcaatatgcagaactttgattgatgtgcattaatgaaaaaatcatttggctaacaattaatcataattatgcaacaaattagcagaggcaatgaattaaccatgccaaagcatttgaaagacaagctaccgagcaatatttttgttttatcacaataaagttccacatttacaaacctcatcttcctgaggacgcccgccatctcctctctcttcttctt

SEQ ID NO: 38 - DNA, 725 bp, Zea mays
aacagaaccatgtcaggcagtttctagtgggagttgtcggacacatgaggatacggacataataagcgggatattttgagtagaatttagtacgtcagttccccggaaccttacccaggtcagcagtgagaagggcctcactttcgtagttgggacccgccaacactgttcccaatggtgagatgatgacactccctccagaacaaacaacggattccggggatggctcttcctctaggccacaaaatgtgtactcgggagggggagggtagttctttctacgacagaactggcacgctgacagcacaaagcatcccccttcaagggcgatatgtgtcatagaagacagccaagttggcatgcaatcaaccgtgggagcacaatatatctcaatacctgcattaacattaacataggaggattcagcatgaaagataaactcagtacatgagacattgtgcaatttagcattacaccatgagcttgttggaattcacctcattccatatgtgttgatgtgtatagggatgtgaattaattcgagttccactccaatccacactaacacatgtggattgaggtagatacaagagtatccaaacaaggccttattggttccaaagtatatcccaacactcctaatttaaaaatacaaatggccaggattagggataatatctttggcatacatggccgtcctgagaaagtgcaatctggtttcccaa

SEQ ID NO: 39 - DNA, 747 bp, Zea mays
gcagcgtccttatgcgcatgaaaacagcagtactcaaaaggagaccaatcagcaaaaagtgccagcagaccacacacacctgctcttcactaatcacccaaaagaaccctttgcctaaaaattacagcaccaggaatctgatcacaacaaccagcaattccaaccagaaacataacaccaattggtattagcattgaacatttaacaacaactcaaactgtgagagatacaacagccccccaggcattttgctaagaataccttgtcatgcaggttgaacccacaccactcatacacagtggcaatgtggaccataccagaacggacacgacctcgggccggaccttagacttgcgctttggcatgggacagacacgaaattttgtttaaaatccagcttgaaattcactcctacgagaagttaaaccgaagacttgaggagttactagagccacctaaccaactcaggtagagacccgttcacagcaaacatttactacactgtaagatgacttatagactgaaaactttacagggaaagtggagaacccatccatgcattaaaaaaaggcagacacagtgccaaggctcccacatgaatgagatctgggaaagggataaaccaaggcaaacctctccccgcaaatgcggagaggttgcttcgaacccacgacctagtgactcgacgagacagctctcacctggtgacccatccatgcattcaactaacaaaatctacatcaaaaa

SEQ ID NO: 40 - DNA, 696 bp, Zea mays
ttgcttacgaagattgaatttggtatgtgcttctgaagttcttcaattatatattttggaagtgcacatcttgggagggctttagaaggacctgcatatttgttatcaagtaaaaaaaacatataaagcgatctcattgcagctgtccggggagacaactagcaatatgtccgaagaagctcatttatagtcctactgctattagtatcacagaaaatgttctaaatagcatggtaaactaggatataaaagaatggaccaagttaatagccataacaagctccatattaaatagaaaatagattacaaatctggatataggagtgcatcgagcttgtggatgtgaacagctatcagctcagtgtgtcactaagttttggagtacctgcatcatcaggtccaggaatgaataagaaacgactatgttcctttaatctagatcgagctgcaatcatctcgccaagctttccgaactgaaatctgtgtggaggtacatagctaagggttatctcatactggaatagcaagaacaaaaagacatacaattctctggcatctctaatgaaacagaaagccgcacctgagttcttcaaatgaattgaacgctagattgcaaggccgggagcagaaattgcccattaaaacaaagagggaggcacaacttccacactatcatacccgtcaagaacaacagcc

SEQ ID NO: 41 - DNA, 473 bp, Zea mays
ttactgtaacttcacaaaaatagcttactataatctacaacaaagaagtcctgagatctgctacgaactgtggagattgatacagctttggaagctgcacttgcctgataaaaaggttgatttggacccttagatagcttatccacgtttgctgtctccatccatgacttggattcacagcacaccgggtccatgccacatatcacgcctctatatccttcagcaagagtgcatgatggtgcaaaaatcaaacaggataaacaagagcattcaccaagtcaatatcgaaaccaaatactaaactatggatttaatctcaaaagcaaatgaggatgaataaagccacagataagcgtagagaatgggacctttttcattcgcttaatgaaatatttcccttttttctaaaaaatctacagataagcttaatcaacagattgaaaaagaacaaacacattatgcatcataattac

SEQ ID NO: 42 - DNA, 697 bp, Zea mays
taatgtaactggggtgaataatcagcaaagcagtgagcgcacatgtgtgtagtagtggtgaactggtggggcgtggagcactaattagactgcttgagtttggatcatacatatccaaatccagtaacaacacgtagtggcctttcttctgtccattcagtcatctttagcaaatcttccatagtatgtatgttctcaaaaatgccttccttaggtacctggtcgcacaagttgactgcttcagatataaacttcaatttgaaataacaagactagtacctatgaatcctcctggataccaacataccgcaagggacaaacgacaatgtccaaactcaagagcatcatgaacaaccactaaatcctcattgccctgacacaaaaaatttaagcacatcggtcagataaaggcttcttcaaagcagaatagagcagacccagtgtcagaggctctggggaagggataaaccgatgcaagcctttccccacgaatgtggagaggctgcttcgaacctgcgacctggtgacttagtgagaaagctagcaccactgcaccaggcctaaaatttcacataaaagaatattgcggattcgattggaagagattaatgttttataatatataggtccagaacccaatgtgcgcacaaaccaggaaggcattagtctaagcacaagataaaccagatataacaaa

SEQ ID NO: 43 - DNA, 739 bp, Zea mays
gtgaatcttaaaagcactgaagttatcgaacatccatatgtccaggtaatagcagttcaactgctccagtttgactaatattccctgttttatttggagtgctaagtctctcttttgctcctattcagatatttaatgaaggacatcaaaatgttcttgtagagatgttggaaatcataacagtaatttgtgaagagctcaaactacccatagctcagacttgggtgccatgcaaataccaaaatttattgatacattgtggtggtgaaaataagagttgcttcgatattcatgaaagttgtgcccaagaactatgcatgtcaacaagtgctgttatgtttcatattatcgatgctcatatgtggggcttccgagatgcctgtgtagagcaccacctgaagaagggacaaggggtttctggaaaggcttttatcctacgtaggccttgctttacgaaagatgttactagattctctaaaatggagtacccccttgttcactatgctcgtatgtttggattagctggctgtttttcgatatgcttgcaaagtgcttataatagaaatgaggactatgtattggagttcttcttgccacctgattgtagagaagatggtgagcaaaaagttcttttggactccatcttagctctgctgagacagtatcttaatagattgcaggtagccactgacgaaggctcaaatgaagtttaccttcaagtcgatgctattactataaa

SEQ ID NO: 44 - DNA, 753 bp, Zea mays
gaaaattgtacattgcggtcggtagagcatacaataatgcaaggagccaggagatcctgacatgctacattcaacaagaaccactatatcagctccggtcctacatttatcatcacggcgacctttggcacctgaaaaatacctggcagcattggacggatcacatctgcatgtctattgtaagagaagatgcggtggctaccttctcccttaggttgaacttccttgctatataaggcctgacatcttcaacgccgaccaagctttctaagaacgggagcaatttcagcagctccatgtcattgggatcatcaaaccagctttctataggaatgccattgtccaactggaacccaaaggcctgcaacgaggaaagcggctttacatttaaatcctgccaaaacccaacaagtgaacaactaaaagctaattcaagatgaataatgcagatgtactgataacagctgcgcatgatccaaaagatcaatgatgatggatgatagatttcagaactacaaaggctcctgctactgctaaaaagtaaagacactcacactcagcatctccagcacatattaagtcaaaagatgatttgtcatgaaatgcacctagggactagccctctatacagaaacagtaaaaaagattctacttatttgttcaataagatactacttattagtttatattagctatcccaataattctgagaagctatgtaatgcccaggaagtaccatgaaccacgacatgc

SEQ ID NO: 45 - DNA, 467 bp, Zea mays
agacatgagtgtaagtcatacataacaaatattgcggactaaaaatgctggtgttactccctccatcccggaatgatatattcatgtaaaagtcaaactttacgaattttggccaacaattattcaaattatataaaattttaaggcataaaaaaggctttgatggattcatatttgaattgcctctgatctgatatcggaactctttagcgaacgaaaacatacagtaagaggaattaatggtcaaaatctaatttgtttgacttttcctgatatgattaattgattatcattccaagacagagggagaatattactccctccgtcccaaattaaaattcgttttagatatttattagattcatacgatgattaatgtatatgtttggtatatatgtctagattcatcatctatttgaatatagacataaaattcaagtgctaaagcgaacactaatatgggacgg

SEQ ID NO: 46 - DNA, 768 bp, Zea mays
  misc_feature (731)..(731): n is a, c, g, or t
gcataaacggctcatgaacggctcatgaaacaaagtctacatggttcagaacccagatctggcccaaaagaacccaaatcagaattggcaggggccaggcgccggaactgtagacttcataaatcaggaacccagatatgggaaaaagttttaaaattacatgatttttgtaacaaagtacagactatatggatcagaaaccctgatctggatcaagaagcagcaaaccgagatctgaactgatcaagaagcagcaaaccgagacctgaactgcgtcgcgtaccccatctaccacaaattatgacgtccactctcccacttggggagatggtaagccaacgcatccaccaagtgcaatgtgggccattgatctaggccacgggccttcttgatagccagtcgaccccgtccaggtaagtatgttgcaaagtaggcaggggcactgcttatgtagcctcctcacgcgtcgcacccatcttcaggcggcgaggtgggactaaccgaaacgtgcctcacccagtcaccctgtcgctcgagcgctggaagtgggcgagcgctcgttattttgcagagcccataaacgaaagcccatgaaatcttccgactcgtgcgcgccaaccttttttgtgctcgctcaccgaccggcgccatcactcgctgaaatttcttttcccaatccagttcattctgccgctctccaatagtccaatccggtcgcggcgaagctcggncagacgggcaccccaatgccgtcacggtcgggctccc

SEQ ID NO: 47 - DNA, 746 bp, Zea mays
aagtcataccttgctatttgagaattgaactattcgcctagatgtgggaagaaaatgagatactcttgttccagttccagatccagtatcatcaactttctgaccatgtccactactgaactgcctttgtagtgacgagtggttatgtgcatcagatgatctctctctaacacaaagaagcatccgtcctatcatgtagcaatacccgatcagcatgagaaatgacaaattcactgtccccaagtgttgttctaaactagaaatgggtactacaacataagctttatactgcatgcagtctcggaaaaaaaaacaatagtggaatgcccatcccttaaacatttactaatataacacttggttcacaatcatggtttttaaagcggcaaggcggtccaaggcgttggaccaccgcctggacacctaggcggcgcctaggcgaggtaggcgggcaaggcgcctaggcgttagaccaccgtccggacgcctaggcgacgccttaagaacagtgttcacaatgattttcaaatgagcaaatcagctgaggaaatcttctgaacagtacagtgacaaaagaagtttttggtagacctaaagtcaattgcaacatcaaaggacagctatgataattcaataaacaatagctagcaacggagaactagtacctaaataatccccatttcataattcaatatgatcatcagcgaagcaaactttaaatttcaaaaactgaaaggaaaaactaa

SEQ ID NO: 48 - DNA, 772 bp, Zea mays
cacccctaccaaatcgagcacagctcagaagaggcaggggaggatcactctcctaccaaccaaaagtcacctcgacactggacgtgatacaagagacacaaaacatgggccagaagacaccatgcatcagacagttctgagaacttattcaacagcaaaagtcatcttcggatttgttggcttcctcgttccaccatcctttttggcatcttttcctgtagaacagaccacgaatccaaccaaaagaagcaagcataaatcacatcagtagggtcataaaagaccttgttgttaaagcacacatcattcctaaacttccaaatggcccagagaatggctcctatgcctagaacaatcaaattcctcgtggttttcttataaatgttcatccagtcctcaaaaagagaatccaggttttgaggacatctcttcacatccagggcaacctgaagaactctccacacaaaagtggccactgggcaattgagaaaaaggtgattggtggattccaaaacaccacagaaacaacaatcagtcaacccaggccaattccttttttcaggttttctttggagataatttttaatcttcagaacaagccacaggaaaacttaaatttttgaggcattcttattttccaaagaaacttaggaactttagtatgacgtcaaatagatatacttggctaataattttgaagaatttaatgattattatttggtatcataaatgctattatttgattatataaaaattggtcaaacttatgatg

SEQ ID NO: 49 - DNA, 804 bp, Zea mays
acttgctgtttgcaggcaactcgagctccttgacatatataataattccttcaccgggccactcccagaccaggtggggaacctgtcaacatatctaattgaatttagagcaaatgcaaacaagctatccggtgagcttccgtcgtcattgtcaaacttaagcagccttgttagtatctattttcacgacaacctactcacaggagccataccagaatccatcacacgtttacaaaatctcatcctgtttgatgtcgccagcaaccaaatgtcaggtcgtctcccaacacaaattggcaagctcaagagcctacaacaattctacaccaatggaaacaaattctatggccccatacctgacagcatcggcaaccttacgtcgatagaatacatctacttgtccgataatcagttaaattcaacagtaccatctagcttgttccagcttcccaaacttatctatctggatctttctcataattccctcactggttcactaccggtcgacgttagtgggctaaaacaagtggattttgttgacttatcttccaattatttgtttggaagcatcccagagtcatttggaacacttaagatgctcacttacctagatctatcattcaactcattggagggctcaatcccagtttgtttcaggagctagaaagcttggcatcattgaacctctcctccaactctttctctggtacaattcctcagttccttgccaatttcacctacttgacagacttgaatctgtctttcaatcgactagaaagaaaggtacccgagggaggtgttttc

SEQ ID NO: 50 - DNA, 770 bp, Zea mays
tttgctgcctgcagtagtatgaattcatcaagggcaagggtgcagatgtcattccagcatttgtccaaagacaaacctttctttctttaaccatcaatttctagaaattcgtagtttattatcgtatgatttaagttcctagattaaccatgagaaatactttcatagcatataatttgcatgttgttaagctgtatgaacttgtaggaattgttggtcaaagatgtaaatgtttgaataaggacaatgccaaaatgacaattaaattgaaacaagagtatattataagcttaaacctatgtggccatcatggttcttaaagcggtaaggcgacgtcttatctatctaagaaccagcaagactaacatggagaggaagaaaaagaaaaaagaaaaagaaaaaaaggggtagcaggcccagcccaccatctagcccacatatcctccctgttgccctcctcctgccgatggggccgcccctgccctcgaagcagccgtcagcaccctagatttggcgttgccgacctcgattcgggctgccgccgccccgattcgagccaccgttgagctgatttggtcgtcgacgccccgattcaacgtgccccatctcctccctcttgctggttcttcgctgggcgatggggacacctagccactttggggcgcctggacgcctaggcgacacctttaaaaccatggtggccatagaagatccctcttagtgttgtatgcaaggaactaaggaaggtcctcatcaagttgcaaaagctg

SEQ ID NO: 51 - DNA, 780 bp, Zea mays
  misc_feature (718)..(718): n is a, c, g, or t
accaaattaataaagctttgggacatactccatcctgaaatgataagcatatttgatcagggaaagtcatacaatgtagctttggacccttaatttcttttaaaatatgttgtcatttgctaaagagttaataccattttagaagcactttgaatacaaacttattggtgcaagttgtatataatctaacaaattgttggtcaaagtttgtaaaatttacttcttgttcaaaatacgcttatcattctgggatggagggggcagttccttaaatcattaatgaaaaagtttgttacgattccattttgctttctgttctctgggtatcactatatgaaactctgtgcaggtctggaactgttgcatctggcacaaccaaagcagatttgctttctacacaaaatggtcttgttatgcgacccttaaataggagtgatcaagacaatggtttccatcctactaacaaaagggaacgtcaagctgcattagataaagaaacgcccaacccgagaaccattaacaagtaagatgtgcttttttacctgttctgctctatgctcctctattttatcatttaccacattaaactaagaaagttatcttctgctgcacactgagtcctaattctttcatcataactgtgattagtatttcaccttcaccgccaactcagttcacacacttgaatgaacaaaatcaggccttgacacattgattnttcaggcctaatgaagacgacagtggatgtaacattgcatcattaccgaaggcgaatggatc

SEQ ID NO: 52 - DNA, 777 bp, Zea mays
tttaccggaatgctccaaggtgaggagctctcacaagcgtacgccagtggagatgtatttgcaatgccttcagaatccgagaccctcgggcaagtagtgctggagtccatggcttctggagtcccagtcgttgctgctcgtgctggagggatacctgatataatacccaaggacaaggagggtaagacaagctttctgtttacacccggagatctcgatgagtgtgtgaggaagatagagcagctcctcagttcaaaagatctcagggaaaccattggaatggctgccagagaagagatggagaagtgtgactggaggacagcctcgaagaaaatccgcaacgagcactacagcaccgcgatatcgtactggcggaagaagatgggcaagactaaccagacctccttgtttcaggattcttctgtcgctgccctctccaactagttgctgttaataactaaagaatttgtacattgtacccaaacagcttgcgagttttgtgtggctagctgcattcaaatgtccacagtctgactgactacggcttgtattcgattcatgtacatttagacagcacttaagattgccgatctgctaactcagaaagtttggcacaaatgctccgataattttgacgtacttgtctcgtgctgatgtgcagtgtagaggcttgttgctgtcagtggcttcggccatgttctaatgtaccagaactaatagtagctgctaaaaataataaaacatttaacagtctagctatattaactattatgattt

SEQ ID NO: 53 - DNA, 413 bp, Zea mays
tgcatgcctgcagctcggggttaggttctacgtggtagggtgctccgtgggcggctacccagcatggagctgcctcaaatacattcccaacaggtcgtaccactaccaccaccgtctcagtagaaaaaacaaaccgcagcaggtgtggtatcgatcagctcgtgtatatatatatatgttctgaatgggtgggctctcggtctcgtcgcaggctggccggagtggccctggccgcgccggcggtgaactactggtggccgctgcctgctaacgtgtcgagggccgcgtacgggaggctccacgcccgggaccgtaggaccttctggatcgcgcaccacgcgccggcgctgctccacgcctggctcgcgcagaagtggttccgggtgtcgccgatcgtcagggccgagcgcgac

SEQ ID NO: 54 - DNA, 795 bp, Zea mays
acaaaaccggaagcttgttttccacatttcactagtcgattggcacttccacctccatcttaaggccaggatggtcgatgatctgaaacaacagccacaagaacacattctcagacgtgctaccgacatataagacggccacaaggcttgtagatggatatggaaccgcaatagacatcgaagaatatgcaaatagcctatgatatgatacagcggtggattttggctttactaacgcctttgcttcccctcttaatagaaaaaaacgtgctttttgcgtggattgtttctacctaggctatcaatacagcaacacgcaattctcttgcatgtgttcagagggagggaaaacagatatatggacacggaaaaggatttctgcacctggataaaatcttcaagcgagaatgcgtaatccctcgtgtaccctgcttcttccagaacttcagttaccacttgctgcaagacgtcaatatgatatgtctcacgctgatattgcacaattccgtataaaaaccacacggccaatttagatatataataagcacctctctttgttcctcggacatgaatgaccctgttaggtcccgtaaaacctctagcagatccttgaaggtaatttttcccttgccatcgatgtcataaaccttgaatataactgcttcaccaaacagacaaagaaaaacgttgagggaagtgagtaatcatgagaacttcatcatgcaacacctacgtgcttttgatataagtaggaagaaaacaaccaaatgcaaacgctatggcagtcaggattac

SEQ ID NO: 55 - DNA, 836 bp, Zea mays
aacatagtaatcctgattctcaaagcacgcaaactcaagaaacaccgggtgctgttgcttctggtccaagctcaacttcagctgttgcaaaccgtgtgacttctgtggctgagggcaagcaagaggcaacggactgctccttgcaggtggctccatccaagccaaatgatccatctcccgctgatctggtgaagaaactgtcaggttcgatagagcagattgaaaagatggtgaggcgccatatgaaggaaactcatccaaaggctgctcagccttccaaggtagttgtccaaaggcgcatactgatgtccatgcgatgagctcagcaacgatttctcttgtctgctgcgttcttggccgctagtcaaggtatgtctagggatggggattcctggttctctgcttgaggacactgtggtaggagtaaaagagggatttctagcttctctgcttgagagcatggctatctgttggtacaacttgccatggtatgcttactgcatacgacttcagttggcttcaccagaaacgaaccactgttgttcacgtctttctgtttgtgaagtataagacttcactgcgtagtagtaaggcgtactagatatttgtggcgtttagttcaccgaaaagatagagcagttacgagttgtagtaacagcttgaattcttgacacttcaattgatacagttagcccttgcttattgtttcaagattttggttgtggttggtgctcatcaaaattctagattctgagttgatatccgaaaaatggcatgaataccctttcattttcgggttttttttttttctggcctcgtttttactgggatgccag

SEQ ID NO: 56 - DNA, 729 bp, Zea mays
ttggccttcttttttggctttaatctctcacaaggcaacttttttgacgaatgtgtaggacacagcataacaaagttctcctggagcaaatcacatttgttcagtgatatggtcaacaaatactttaccacaaaagggcacgcactttttgtttaatacacaatggacagtgcagatttaaggaacaatacttacttgatcccatttgcagcctttgatgttgtaggcacatgggacatgaaaacttttgcggcagctcttcacaaggcagccaagtgctgcgccttttaagccacaaacactgcatttgatcttagaagcacgggccaactcaggccccaagttgtttgcggtgtcaccagtaaagaatgcttgaggagccctgtattggtattataacttagtgcagtaagttttattttggaaatagtacactaaatgatcactacacaggtacagaatgcaaaaaaaatcaaactttgcacctaaaaagaaccagaaaacacaaacttcctgtctcagaatatggagtatgtgtacaaatcagtgcaatgaagtatgcgctcagaaatattatcatgaaagttgccaggaacataccattcaatgcatttctcatggacatgctgaacacttgatttccaagcttgatcagcttctactagctccccattcaaataatgtgacaaagggccagtacactgtaaataacattttacattagattct

SEQ ID NO: 57 - DNA, 799 bp, Zea mays
cttgcaaaactttttttgctattcaatccgcaactgcaattttctctgaatctgcaatataggaatatatatatatagtgttaggataaagcaaacttcattggcattaatattaatgttgggcaaaatcacttagggcccgttcgtttgtgtccaggaatggacacaggattcgttccagcttatcaaaacttatataaattagagaaacaatccgactaggaatcgttacaggcctccaatccgtgaaaaccaaacagggccttgtggaatcaacactaactgaatttagaattagtacctcaagctgttcatgaagccgtttctggacttccatctgaaggcgcagcgcttcagtaagatccatgctcctatacaagaatgcccaatatcatggaagagtattaaccaagaagtaacagacaaagatgatcgtaaaatgcactttaacatataggaaaaccttcaaattagattttatgtttcaaaagaaacaacaaaagtgaatgcaatggctcaatgcacatcatgacaattccataactagaagagggcgttgacacttgacagatgcatcgaacactgagggcatgatctatgctcggagtatctattgttaaatcccacaccatgattgtataagcatttctgttgtaaaaaaggcccttcaagaatagatttgaaatagcttgtaggtaattcataaccctcaaaatttttactgcatgggaaataatgcaaatcgatggatgcaaatgtgtcagcttacaacagtctgaaaatagatcaattctaggac

SEQ ID NO: 58 - DNA, 857 bp, Zea mays
  misc_feature (774)..(774): n is a, c, g, or t
catgccacgcagaaggtgctttccttttggtgcctgtctatgtttcacatgtttttttatctttgtaagtcgaactcgaactcactatttcatgcctgatgttttgctcaggttgcactggagaacggatacaccaagatcatgctgggaacgtgtgcttccggaatagcatgccatgtgctatctgcaaccgtgaaggtatatatctgacccggtgatgtttgattcttcttgagaataatatgagcgagcgttgagagcataacagaattactaatttttccaggggcaaggctacgctttaccagctgatgtccagtatgttgatacgcgatgggaagtacccgtggttcttccacttcatgattgcctggcccaagagcttaacttgctctgtgaaattgataggtaaggtaaaagctcacctattagcctagttgtctgttgtccttgcagtgggtttttattataatggtttctctgttcagtttgaagacacagcaacttctcgataggccttgcagtggcatcaatggcttagtttcatcctttgtttcacggctaagggtagggcctcttgttcttggcatgccactttcttggtgacttaaaattttagctattctgtatgtgagctcaagctgtgttcttgtttgatgactacaacactacgtgtatgaatatcttgtggagctggagcaacacaagacatagttttgaatattttctcatttctatttacaggaagagaactcttctcgagagcataccatnttaagaactgctcaaaagcttaagccattctcgtttaacaagttctcagcaaacggctaccatgatttcctgccatcgcggct

SEQ ID NO: 59 - DNA, 674 bp, Zea mays
gacactaccgttttatttcctgcaactgcttgggtattgtacatctgtatgtgatgtgtcatgtgcacatgctttgccattttgcattggcaataataggttgtgcatcccttcagcgctacaaggagcaaggatgtccgcttcagattaaatccgactgtttagactgctgcaactgtaatcatagagataaatacactatagaaacagtagtaggagccgatacgaattaaaaacaacgaacaggctgaaagatgcagcgcttgtctgcacaacatccccaaagtatcttcgagtcgaatacaacagggtaactgagtgtaaccacagttcgtacagaatttgtagagaaaatgaattgtccaaaccaccggataaattcatcttgttacaatgtttgctggcagaatagctcgcacagcacaggagatgagaccagttcatatgaaatcacattttaagtgggaaacgttcagctctccaacccgtgctgtctctgtaaaatcagtggaaacttgctggctagtgatggtttgcctcaccactatacagatcccagatgagttgaaagataccagtagcagtgtcatgctagtgatactggttttggtcagaaaccaaaaaaaggaagaaaccactgttatcccaataagtttgggccataatgccctgtg

SEQ ID NO: 60 - DNA, 480 bp, Zea mays
tgcatacacttctcagaactaaatgatataattaataacacgactgttcgactaattacctgtcggaagaatggccaaggccaaagcactgctctcctctatcgccaacacagtaggggttgaatcacctaacccctatgagaaaaatatggcatttagattataataaatataaaaagaataatgtcactcactttatgaccatttttatacttaccagtaaatcaccagtatctgcaatctcaggcttgggaggcaaagctatttgggaagaaggaactggagcaatttcttcaacaacttgcagtttctccgctacaattggaacggtatcacgaacttcttcttctggtttgtatgtcagaagaagccgctcaggaagctcctggtgaaataagaaggatagtccgtatttaagaatccattccacaataagtaaatcggctggtataaacttgacttgacggtaatcatttatct

SEQ ID NO: 61 - DNA, 333 bp, Zea mays
tgcagttcagcaagtcaccatttgaggactctcttatagtcttatttcaagttgactattagccatacagagaaagaggcatacctgttggaccagtgtatactgcaagctgcctgtacaacaaccattgggatcaaagctcaattgcatatcccaatcgctcagctaaaggcattggaaaaacaagtagaaagtctagcagcttactcagttgcatatcccaatcgctcagctaaaggcataattcctagcatgctgaaaagaaaaaccaatccctgcaattttaatgtcacgtgaaccatgtcagcattaagttaacaggggggggggggg

SEQ ID NO: 62 - DNA, 717 bp, Zea mays
actcagctgtccctttgagatacatttctattattttctctagactagaacctgcttgtgtatgaaaaaaaaaactcggtacttctgtgttggttgacataaatttcttctgaaactctgttctcaaatgctctgaacctgataaaaatcccttgtttgtgctaccttgtgatttgttagccttgaaaatatctgtcaatactctgttgtcttcatctgtgctggtacctccaaatcttgttcccagcagcaaaaacaaattatatataaaaaagcacgtttaggcactctagacgctaggccaccagtggcctagtgcctatcggatttttgaacatgacaatactccacagatatgaaatcaactgaaatgactataaaaatttacttttccctgtgcacgcatccccaacaaggaaatgatgtcttctaaaattaaattgtttttttcagcttacatgtgatgaaacttccaaagaggcaataacaatgacgaccttatactggcagtagtgttacttcacagcgttccacagataaactagagctatatctcatgcttcgaaacctataattcaccctaccaaacgtggtactatgtcatgaccttagtccttagagatcaaatccctccatcaaattcacggataggacacccaacctacatttatgatcaaatctatagatacttagatagctcacccaacctatatttta

SEQ ID NO: 63 - DNA, 721 bp, Zea mays
gctagtaactggagctcatccagaaataaatcaaatgtgtctccattgaatgtggcgttagaaaaggagatgtccaaggaattggaatcaaagaagaagtcaccaagtgtggttgccagattgatgggacttgaagaagatctacctggtcaagagccagcattaccttccactaaaagaaatttgaagaaaagacacctaaatggcaacttggtcaaaacaaacaatctccatcgacatcaagagcagtaccattccagtatgacaacatgcgacaaacacataggacccaaagaaacagttgaatttaaggatgtttatgaagtcagtgaagaaccattgagaacataccattttcaggaccaaacttttcctagggaaatgtcttccaggagcaagagagacataaggatggaaattgttcgtcagaagttcatggaagcaaagcgtcttgctacagatgagaaactcctgcattcaaaggagtttcaagaagctcttgaggttctaagttctaacagagatttgttccttaagtttcttgaggaaccaaactctactttctcaaagcagctagctggacttcacagaagcccatcaccacctcatacaaagcgtattactgtgttgaaacccaactaaatttgttgagagcgattgcagaggggaaatcataacacacaggaattaaaggaagggaaatgaaacacgttgtatgccg

SEQ ID NO: 64 - DNA, 611 bp, Zea mays
aggctccggagaaggtgacgtgggtgagggccttctacgacgacttgggcgccttcaccagggaccaggagctgctggtgtcgattccggattcggtggactacgtggaagggttcatggtcctgaacgagcggtccctccacagctcctccatcgccttccccgcgagcgtggacttcagcccggatttcggcaccaggagcagccctaggatctactactgcgtcgagttcgcggtgcaccaccaccacggttaccagaagcagtctcaggcggccgtggaggccatctcgaggcggatgagccacatggcgtcccagctgtacagcgtggaggtgtcctacttggacttcctgaaccgggtcaggatggaggaggtgagcctgcggagcgccgggatgtgggaggaggtgcaccacccgtggctcaacatgttcgtgcccaagcccggggtcgctggctttagggatctgctcatggacaacgtctcgccggatagctttcagggcctcattctcatctacccactcctcagagacaagtaagtaccactcttctaataataataattatgatgacacaaaagctatgtagtagtacatccatgaaat

SEQ ID NO: 65 - DNA, 526 bp, Zea mays
ggtgcactgcagaagtgactcggctagggttacctttgtggtggtggtggtgctccagtgcactgccatgccactgctactggcctgctgctcttgtccgaacattccaaggacggtcgtaccgtacagatttttgggtgttcttttttgttcgattcagaaggggaacccagttcaaccagccacatgcctaccggctgccgtaccatgctcggcaagacgctgcacgtgatggaaccagtaatcaatctccccatggaccaccgctgccaggcgtctttcagaaaccaaacgcaacgaacaggcaggcgcacggggattgcagagaaaaatcagggttcagctccacagagcgtgtgcagtgcagaccgaagccacgcttctgcgatctgagcctcaggagattgcttgcattgcagctctcacgcgacgcaaccatctcttactctgataggaaagtagagtgcgtgtgttgcagaagtagcacacaagcaggccgaagagagatagtactagcaagaaacaa

SEQ ID NO: 66 - DNA, 736 bp, Zea mays
aactcacaagtcaatgatggttatcaggaacaatattgtcgtggggggcattacttatcgcccttatgcaaggtaatgctgccactttagttacaatttgttatgttgacattgtatatttgttgtgcttaatggccaattcaatatattctatatgtgctctttctgtgtgaggatccaatatttttttgcaactgaaagcaaatgtctcccaactgacaccactcacttatgagaaaatgttggccaatcaagatattgcgtcgtaactttgtacttattcaggaaatctattattttgatgataattaaaagctggcaagttagaatgtaggttgcaaacatttgcatgcttttgtttatcctgcaatatctctctattatgctattttttcttttggaaatcatagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcaggtatggctgcctgaccttttaccttatataatctatttctttcaatttcttgtttgcttgtatcagtaactgaaagacttcggaaactacatgtgtgatatacttagtacaccttaacctcacacaagagatataagtaataactcaaaatacttga

SEQ ID NO: 67 - DNA, 801 bp, Zea mays
gcagattctcttatggtccagtatatctgttattacttaatatcttagttaccatattttttttgaggggaatagttaccatatctgtcagctatgacacagtctgcggtaaaagcatatgtgttcactgtagattttgggagggaaattggcttacctgtactctcatacattgttgccttgctggcaacatggttaaccaatgacataacatgcaaactgtatctttttactatttaccttaaccatgccagctttttatttggttctaggcatctttttattcttccttgctgtaatctactggattgtagcatgaacaccttcatgggttttagcttatgtttgttgttttcaaccagtggtggcctgtgatatgtctactgtcaaatctgggacatactatgttgcaggcttctctagtccgtatttggctccaatctgtactagaacatatactcatttatctggtctactggtttaccaaatcatattacagaatagttgtgtgtattttgtgttccagcactttgttcactgaaatttgaaatcccagtttcttactcacattaattaacttgccttttcccctcaagaaagtgggcggaaaaagtaagacaagggtaatgctggactacagcttgcttcttttccttttatgcatggggatgcttgataatgtcatgctgagaaacttaattagttctattgatcttttttataactctcacattcttccactgcaactgtattttcagttattttagtcctgccttaataatgttctccttttttcaacac

SEQ ID NO: 68 - DNA, 844 bp, Zea mays
gcagtggcttcttaacaatacgttttccccctagattcagtaagttcattgaacttttgggcagccatgatcagtgaagagtaaagacttccccaggtatgcaaaccctagcccctaggcgacagtatataacatgactagatgtttagaatctagatgtagaaatatttaggtgcaaattagttaaattgattgatgggtacattgttgatgcattatgtacttccttggattgtgaagaaggattgagatatgaaaagacagtaaagtttccgcggttccacagacgtcgtgtgtcacccttccacttcccgctttatgcagcaaaaataaggtaaaattgctttatgcagcaaaaataaggtaaaattgtgcacaactaaggattcaaaacttggtggttggctccacattcacatatatctaaccaacagaacaacacatatttttgtgttttattaaaacaaagtctactcatgtgatatataaaaatcatagcaatgtacgggcatctaactagtattgtgttatttattagtactcccttggttctaaactataaactttcctagatacgtagctttttttatgcacttacatattacactgtctataatctgtctagatacattgcaaaagtaatgtatctagaaaaaacaagcgtcctataatttcgaacgcattatctgtgtagtgaattgccggcaaaaaactttgtttgttcaatcgattttcctaaaatgtcctttttacccgaaattacaatgtggggaaaaaaatttgaagcattaccccccatggaaaaaaaaatcaatagggcccccgcccaactggcttccggggg

SEQ ID NO: 69 - DNA, 702 bp, Zea mays
gagcattcgagctctgttgcggcagtgtccatctgcttgaatgtatcttggacctgtgaccacagttttccagcccgtatctaataaaaagcaaacagaaggttagtgaaacataagcactctgataacatgctattgaattgtcaacaattttgtttcaatgaataagggagcaaattcggtcaggaaaacagcaagagctaacaatactagtttgcagcagccagtggcagacctaggattttacaggagggcatgccatgcattttgataaacttgtttagcgattcggtttcaaggctctcttgggaatgatcttgatcaggttgaaagcatgctctgcaattggttatccaaaaagccagtgagaaagtttcattaccaactgtggtttgtacagcaacaccaacaacgtttgggcaatataagggccttgcactggtaaacctgcccaaacatgttcctcatcaatcttccgtgcccacagccatctgatacggagtgaccagccgaaagtttcaaggttatgaatgcctagctccccaaactgaatagggaattgaaccttttcgcacgagactagacagttaccccaaagaaacctgtcttttcttatcaataacttgtaacactcattttgataaatccatggcaaccacaagataaaacaggatagcatggagcaccgcccttagtttgggg

SEQ ID NO: 70 - DNA, 615 bp, Zea mays
agagtcgacctgcagaggttcgcctacgactacgagggcaatgttcgcccgctacaacgtcgcgcgcccgcctctgcgcgtggggacctgtcttcagcttgaacgtcttcgccaccgcgcggggacatcgctcagaaaatacgtgcctttgccagcccgtcgtgcaagcaattcacgccagctgacaggcgcgccagcatcatagagcaatgaactaatgatggccaaatttacaacatagcatttatttcgatggcgccaaaaaatgcggattggatttttacacaattgctagcaaagaacaaatcaacatatctcggacgactcacgaaacaaacaaaaaaacacgggcacacgcacaaataaggaatcctctgatcctaaagttgggtatgtacaactaaagttgcagattagagtagtaaccaagctgagttgcgtgtgatgaccctacacgcaatcgtctgatcctccacaccaccactttttttgtgtgtgtttctcatctttctgctcgtttattattttttattatttattgcgatatgagattcggatcattcctggtggatatgaatactgggacaaccctgagcgatgaatcaacggccctgc

SEQ ID NO: 71 - DNA, 764 bp, Zea mays
aagacataactacatataatttctattgttatcttttgggggtaccatgtgcactaacacatactgcattcgtggatctgtttattatattgtgcaggttaagaaaaagttggtgaatctgggtcatgcacagaggtacgtcgtgatttgctaatatgttattttaagaaaagggcagacccggtatcgaaggctcccatgtgagtggggtttggggagagaaaccgaggcaagtcttcctccacaaatgtggagaggctgcttcgaatcagcgactggtgcctcagtgagacagctctcaccaccgcaccaggcgtgctcttcgtttactaatctgctatttaataaagcacaatgaacagactaccatctttatgttcaaatcgaaaatagtgaggaatcacttcatttgctgattttaagttcctggcctaatctaaatgttagttttttaaggctttgaattccatacgaatattgggaataatctgaaaaatgtcattttttattcttatatggaagttaggaaatatgcaaatatgacaaactggggtgaactgcaagtcctgtgctactatgatctaaatggttacatttttaccagtttatatttctcaagattttttttcttcgtttgatgagttggtcagtgtccatgatcctcaagctaagctgttcttatattctcatctccagtttggctgatgtctatgttcacctgtagattagtttacttaattgggaggtatgattatatgccttat

SEQ ID NO: 72 - DNA, 798 bp, Zea mays
atcttgcatgcctgcagaaacgttggcaaaatgtaaaaaaatccgctacagctggttttctataggtcacatgtaaggttactaacgtcaaccttaaaacaatttgctgctccactgaatgtgcaactgtgcatggcgatactaataactatacagcaatcaaatcataaagaaagagaaaaacttggacgaacctcaagtgctttgcagactttatcgacctcgcaggcatagtttatcttctttgatgtcattataagttcaacaacagcgatacacgagtgagcggaaggatcaaaaacaggcagagcgactgtaccatggacgttgtagctgatcgcatggttaagtcgttggtactcaccactgctatagtactgcacattcggtgtccactcgggcaccttttgcttatagacacgcccaggtaggcccaggtctccaacattttccgcatcaactgaaaacatgtaggtcatggatacagccctgtactgaagtaggccaatgctctggtggtcaagcacgaaaggctgtcctgaagtagtgagcacatagcggtctccattcttgactggtgcccagacttggaccagcagatgttgatcggtggactccttgaagtagcgaagagcgtgtgtcagcttctccttgaacaagctggagttgactgtgccatcttcgtccagggacagatgaaactgccatctgtgactgatctgttcagctggcttgcttgaagtgtgagaattccctgggtgaaagaagcaagattgtaaggcgaggaacgggatgctg

SEQ ID NO: 73 - DNA, 737 bp, Zea mays
aacaggcatccactgttcagggttttttttgtttgttttttctctagccatttgccaacacagtttgtatgtttcaactaaaaacggattaagaacaccgaatctgctttagcacttcgtcgtggtaaccaataatacgagttctccatggacgagcgtgccccccagcatatatagctctcaccttttcttttttcttccatgccaatcaaatacaagccccacttggcatgcaaatctccatcagtacagccccttgcccacacacacaaactctaccagtctaggagtaacggaagattttcttacctctacgccacgctctcgcccttatcttcgttcatctcttttctttgggagattgagagagggaaaaaaaaagacgacaaaagcatcggcctctcgtaaagacagagacagagagacatcatcgcgaaagggacgggacacgaactgccggccgaaaaatggcccgggccggggccggggccggccagtgggcggatgtgacccggggggggcagttggagaaaggcctgtgcgcgccacacgtaacgggcccatccgtggcgcgtatgccctccgcctcgcccccggcctggcggcgtcctccacccagcgaaagcaaagcaaagcgagagaagaaaaaaaaagaaaggaaaaccgcgaacgaaaaaagtgccccggttcccggtcccaacgttccctaattcgcccttttggttttgtcttgaact

SEQ ID NO: 74 - DNA, 805 bp, Zea mays
tcctttcatccagtaacggtatcctgactggtttgggacaactttctggtgtaattgaagagggctattttacacgaatgtctttgctgttgttttctaaggcatgtctttattctaatcctgaagatatcgctttgatacctgaatgtgtttggcagaagttggaaaacatgcaaacatcaactggtaaaatctgtgataattgaatattcagatttctgaggcagcatatataaatttcattgtattccctatacgatgtcctgcttgttcaagctattttttttcttgttatgtactaggaggttttggatatatggagaaagatctctgcctagctctgtgccaactaaaaagtgaatcagatgctacaactgtactgccccttcccaccccctctccggtacttatgtactgtaacatgtttaccaagtaccgacttcaaatctcttccattaggttgcaaaagttctttctggatgtaatagtcaaccagtcagccctgatttcaagagcatccgtgaatcaatcctccaggtcagtgttttgaatgatcattattatttttggtcttctccatctgtattgtcgcttctatttctactttattgcacggttatctgtttcagttcattacttgatttatgttctcattgttgatcgtgcctgcatataagactcattttatattttgcggacagtttcaatctttgtaataactgcacttagactaagtgtgcccccaaaattggtaatggtttggaacctttttgttcttctttctttaaaggaaaattctttctag

SEQ ID NO: 75 - DNA, 785 bp, Zea mays
agcaaagcagttgcaagaactgtcttaccaaagagaagagagcttaaaacgctgggagcatagtattggttctaaagaggattgccttcacaggttggtacttaatctctgatttaagtgttaggaaacatgatgtcttaggggatgtgcttttattgtctttcttcaatttttttctatgcatattgacagtcattttgtgcacaaaccgtggtgctcttttgtgaatttataagcactgtccgtttagttggacctgttatctcatatcactaattcacttataaagaacagtctataggtaaatccttagcctggaagctacttgcgtttccaggaatagtattgcaccattagcaactgcttagataaattaagtaaatgcttaaaatggaggtggaagcgaccacaaggacacactatttagctgctgatgttgcaactaaagactctgattcagacaagactgtgctactggaaatttagaaaaaaaatggatgaagcttacacaacttattgcatagttgtcttttgtatgaacatgttataaattatcaccattttaaatttaaaatcgtggaccaaatgaaagaatgacaggtgtggattcatatcatttgggtcatattcttgttattgttgtgtactatatgtttcttcaagagtatcatcctgagaatgcatataatctagctcggaatcatgaagactcatgtcaagtggatgccctgacatggcaaatagcaacaaaacctgataatccttcttaatgtacttgataaatg

SEQ ID NO: 76 - DNA, 804 bp, Zea mays
tcctcatggagtgctgaagctccagccccacaccagaggctgctggaattggacacaacctccataatagcatggatacacgaccttgcagcatcgaacacacaagcattcctgtgtttccgtaactcccaagcatcagcggaattctacaaaatattcaagattgtgctaagctgtggggtttggctggagcaaaagctcttaaaaggctctggccttaatctaggatttagttcccctgtactttgaggtttggtttttggtgttttagctcagttttttttagtttctgctgccattcattttggcggcttgtacttggtctattttagagctttctgttcttaatatagtgatacacaattctcctgcgtattcgagaagaaaaataactcccaagcgaccaagatgatcaacaaattgagacaatgagacctttcttaaactcctttgaaactctctttgacagtccggctccaccaaccggagaaactattagtgtcaggtaggggggcagcagcctgacagaccaaccctatgcaaaactgatgcccagacctgtctagagaacatacaggaaactaggatgtgctgaattgtttcttcagcttgatcacataacgggcatgctcaggatggggcagtccattttcattaattgaaaacataaacattttcctttctttttgaaactaataaattaaaatgggttgcttttaggtgatggattttgagtggtacagcaatgcctcaaaattggttggaagatttaaataaagtggcaaattattctatggggtttta

SEQ ID NO: 77 - DNA, 755 bp, Zea mays
ggtgagcgatgaggatggtgcgctggtggacgcgctcaaccgtcgagctgctgtttctgccgccgcccccagcttcttcgaggggttcgcgctccacgggatccgcgtggagagcatccgcccaggccacatcctctgctccttcacggtccccgcacgcctcacctccggcagcgatcacatagcccccggcgccgtggtggccctggtggacgagatcggctccgccgcctccgtgtccgacggccaccacctcaaggtctccgtcgacatgtccgtcaacttcgttgacctcgacgccgccgcgcccggggacgccctccgcatcaccgccagggcgctcggccacaagggcgcctactccggcacgcacgtcatcgtcgccaacgccgccacggggcaggtggtcgccgaggggaggcactcgctcttcggcaagatgaagatcaggagcaacatctgaattggagcatgtgtgcacacagtgctgtgtttgttgtcgtgtgctctgcttctcgactccttgtcaggaatgtaatggcagcagcttgcttcttcagtaaaaaataaaaaaaaaacagctccattattatgtttattcattctcatgataccacataacaatcaagcacttcacacacagtgatcgttaccgatcagtcagtacaaggaaaaaaaaacgaaacattttattcccttcccagcatgcaacaacagatgcccactgaactaaagcaagtcaagttccaacattc

SEQ ID NO: 78 - DNA, 821 bp, Zea mays
cttgaagtcggttcttcccaaagctgcccggttgctttgctcgctttatgcagatgatgctgcaatcttggccaatcctgactctacggaattgcaaaatttgcaacaactcttgacagtcttcactaattgctcaggcctcaagtttaacctagcaaaaacggaaatttttccaatttattgccaatcaactatggtcagctcgctaattcagcactttcctgggaggatttcgtccttccctggaaaatacttgggactcccattacacaccagaaaacatcgatgggtcgaggtgcagtccctaattaataaaattggagctaggcttgccggttggaagggaaagttattatcaaaagctggcagagaaacgctagttaagattgttctatcatctcaacctatctaacacttgacggtgttcccacctaaaaaatgggtcattcaaaggattgatcgtattcgacgatgttttctgtggaagggagatgaccgtgaaagtttgagtggaggccattgtctagtcaattggaaagtcacagcgaggcccaagtcactgggagaccttgggatctttagatttagagcgtttcgcacgagctcttcagctgcgctggatgtggtacagctggaggaatagtgaaagggcatgggtgggtatggacatcccctgtgataaaacggatcaggacttatttcatgcatcaacggtgactacagtaggcaatggcaataaggcactgttttggaaatccaattggatctttgggagggcagctcgtcatattgctcatcatggtcaaaaggggacttgagaa

SEQ ID NO: 79 - DNA, 756 bp, Zea mays
  misc_feature (744)..(744): n is a, c, g, or t
tactgtcctcgacagctgtaacgttacgttttgtgtgttcccttgtgttattgaacttatattatgatccataaataaagccataagcgtggcagggtcattccctgaccaccttcaggcatcaccatttgttggccgtatttacagtactcagcttgctcagaagcattgttgcaacagtagtagtgctaccaagcaagctagctgactaggattaggcaatgtttggtttgagggactaaaaatattagtctctctattttagtactatttagtttctaaattactaaacagtgagactaaaatatggagtaaattgttttagtctttagttcctcaatggataactaaaatgaactaaaccatataaattcatcttttgtctattctttattttagttgcaataatgatgtgaaaatactaaggtgtattttggtccttttattattcatttaatgtgttttgaatatttttattctttagaacctaacatggtagtgactaaactttagtctcctaactaaactttagtccctgaactaaatgaaccaaacggacccttaaaaatagttttggttggtttcaaatgttcagaatggaagcaaatcatccgcagttatttaactcgcatttggatcaatgtgatttcagttcacctgtgatccaaatgcacccacagtgatccaaatgcagtttttatttttcacgagtcgttaaggttctcttaatacttcttccgattntttatttgtcac

SEQ ID NO: 80 - DNA, 771 bp, Zea mays
ttttgtcccggcattcatatgcagatttgccaaatatatggaatggaactgagaagaactcattgtatataaggccacagtatattgagaatattgccatcagaagaataacatatcgtccgccgaatgccaactccataaagctaccaagcttctgaaataagttatgaaccgaaggttacaggaagagattaagtgtgcttgcgcaaacactgtgaaataaatagcaagatgcaaagttcgaattaaggctcctgaaacagacaagcatcactggaagagattacgtgtgtttgtgtacacactgaaataatggcaagaagcaaagttcaaattaaggctcctgaaacagacaagcatcactggagccaaaggggccataaaaaactcttcagtgggtttcctgcatgcttatgtgttttactggattccatttgcattacaggactgattttctgaacttgtgtgtaatcggttatctgccatatttctaaacaggtcctgtgatataacaggttccttttttgcctctgactctatcagaatgaagtataatacgctcaaaaaagattaggagtagattgtttaagaatattctttaggcgctaaaattcctttgtgatatttaatacagtataacataatacatatacatgatttgtttctaatggttaattggttatggtaaagaaagaaagaaaaggaataaagttcagcatcatttacctgagaggaaaatctcttctcgcgaaatataagaaccaaagctct

SEQ ID NO: 81 - DNA, 802 bp, Zea mays
tgctgcgtcgtcgtgttgttacgatcgtccttttttttttgaaaatttattgaaggcccgtgcttcttcttctcttcttcttttccttctccactgttttcctcgcatgctacatgacagtctctctctctcgttaactctgttggtgttcttattatttgatccggatgcaagtaatactatacaaacaggaatcgggaatgcacgctcccaatttttgacgcctccatgcatgtagtggcggagttccgtaaaattaacgtccgagatgtactattctatcttttgattttttttttcgtgttttatttaaaaataaacagcggatgataaatatttaataacggagagtaacatttaaaacaatccagttaaactatgacaagtagggaaagtggattagatattcgggaacaattacttacaatagaggagaatcacgagcacatggcagcagacagtcaacactcaggacacaacgttcgccgctcaggtggccgttgttcattggccaaggaggcactctgcactcgcctatgaataacaaaaaaagataatcaagttgagaaagttatatagcttggaagaagatgtaatgacaggggtggatttgggcggtggcatggcgccagcccccgcgcgcgacactgctatagggtcgcagggaggctggaggcggatggtggaggccgatgccagactggcggtggtggatgccccgagtcaagcccgccccgaccgcctcggagggttgctggtttgttcctcattgccgaattccccggaagcccttaaggctttt

SEQ ID NO: 82 - DNA, 757 bp, Zea mays
atggcgagcagaatataagacgggcagtccctcttgctcttggtatactctgcatatctaatcccaaggtaactggataaatttatcttgtacactaataaatctctgatacgtgagatctactggatacattttttatgagtgtagtttaagaacttcaggtttcaagcaaaactttatgccccacatggaaattttctgtcctagttgataaattgctcaaattatgtttttatgcttaagaaatgtctctaatgagaccatcctaatggaattactgtgtgatagtgctaactatttgatgcatttgcatcagcattcaaacacaaatgtgtgcttgcattctagacagctgtttttcccaggaaaaaaatgtgaccatgaaacaaatctaccgaaagtcacgtctatataagttaactttgttttattgtgcctgtaatataagtcttttcctaatactcttggacccagaacccgtcaagttttatccagtgccatattaaaaatatatcatatcatagcaagccagatttactgccgtgcctttgtacaaatagattctatcacacgtataattttttgcatggcgctgttattaatggccaaatgaccaactcttcactgcaagctgtactccatctaattccatcacatgttggcttccatttttttgtcagaactctactattttaaatagtgaagattatatatggtatggacctgtaacatcaaccccctgttgtcaatacatgtg

SEQ ID NO: 83 - DNA, 742 bp, Zea mays
gcgctgtagttcaccgccgaccgggagaaggaccccgtcgtcacgtagcaggaggcgcaggagcccgccatgttcatcagcccgatcgccatcatctccttgttcccgtccacctggtagttgttgatggacgcaaaggtcctgcccactgcgatcccttcctgcaaaaaatttttgttcagtttttttacacatctctcgatccttcagctgcatgcagggtactcaaaaccaaatcttttcatttctcttactgttaaggacaggatgcctgtcatgatcccggttttgatcgtcagcgccacataggagccgctgaagctgagcatgttcgccgaaggagggttcactcccctggggaggatgccgatctgtgtttacacacacacaaaagtttttttacagagatgaactgacgaataatgattggtgaggtctcaatggaactgaagatgcttacaacactgatgctgggggatttccagatgaaggagaggatggtggagatgatcaccgacgccaggggagcacctgctgatacccagaaaagctttggattcctggcgctctgaaaacaacaacaacaacaacaaaaaaacgattcataagtttgtctgtcattcattggtttgtctgtcactaattcattgcttttataatcacaacagggcaaacagttggctttgcgtactgtaaaactagagatcccggaatttctttgcagaagaatcgtgtaaaaaac

SEQ ID NO: 84 - DNA, 773 bp, Zea mays
tcaagaactataaaacttaagagccataataaacaatcacttaaaagtttggacatcattcaactattgaaagttacaacaggaaaaaacattcacgaaatttgtcagttctgacacaacaaaagtacacaaaccaatggctaatttcttcaatcctcaatcctcataatttagaatagaacaatattttatcttcgggatctcaaggaagcatgttaagttgttaactaacaaattggttgctagcaattagagttagcagctagctttaacggatagcaagcaactaaaagttgctagctagctattaattctgatcactgtactgggtacccatttcaaaccaattatatcagaaaaggagcatgatatgtcagaaatttagatctggttcctaattgaacaaaattccatgaaaaaaaatcattgcataaatattgctctggcgtagtgatatatatagcataagtagaagtgaccatcaaggaccttatcatatgaataattgaatactgctgaatattgaggtggtattttgaatatagtagatctctgctgctaagaaactagtaaaaaagagttggattgagttctgtaggttcaaaaaaatgtaagacaatttgtaccaccaccctgctatgtaccagtaccacacctgaacatggctcttgggctgatgttcaggatatccatggttattcctcataacctcaatttaaggaaacaaaattcagtatgaaataatctggctttagaaaatatctagtaacgtt

SEQ ID NO: 85 - DNA, 793 bp, Zea mays
gcatgcctgcagctggagagtctaggtgtttactgtgaccctgatccctcaaaacaagttgatcataccatcactgatccaaatgttgtattcttctggggtctcatctacagaaggaatattcaaatatgtacaaattctctcaaagaagatttcatgaaaagtgtctgcaataacatctatgggaaggaaaaatgtgcccattcagacatcacaatggccgttgttgggcctccccagctgccaaaaaagtgtctgtgatctctcagtttactcagaaaagctgccacaacatatgatggggaccaactaatgaagcagaactacaatgcagtcagttaggctcagctgtcatattgcgtgcaagcttcgattgtgaatattgcaacagtaagaagccgccgcttcgattgtgaatatgacaacagtaagaagccgccgttgaagtcattttcaacatcagatcaggattttttgctgccctttttaaggggcttgttcatgacatggaatgggagattttttttttgtgaagtgtagaacaaatgcaggaggctcctagggttcaagcatccaacaaaatagggccattcaagcgacttattcctgttatgagttttgtgcaggtacatgcatattcatgtacacatcatagcaattggaggtatggtatagctgtttgtaaactgtacgtataatgtttccagcagcaaaaattgtgtagaatgctttctgttagcactgctgctgggcacagatgctgaggtcgatgtggagggagattctgaatgga

SEQ ID NO: 86 - DNA, 804 bp, Zea mays
attgactttccatcatgtggcctgtttacccttttgggaccttattatatgatatttggcttgaagcaaaatatggcacaccaaaccttagaaaaattaacattgccaaaagtttgttaccaataaacccatgggctgtccaaacattagcaagaaaatagactatggtttcacttggcaagggaaccttgtcgaatttctgtgggaaaacagatgcttgccaaatctggttaacacagccagattctgctaatgaaacattggctcagaatcttgtagaccctgatgtcatggccccatggtactgtggtctagtgcttgtatctttttagttggtacaactcatatccgtttgtttctaagatatttttaagattctactatgatttctttagcctcaaaccaccatgggtcctcttctgagctcatacaccatttttccaactaacatgacaccaagcaaacacttgggcatatacattctgctgcatggctgcatcatcatatttccacaatattcttagatccccaaatatatttcttggagcttggtttcccttcatttatgactcttcacagtattaccaatataaagtttaaaatccacatgcttgtaggctgtttttgcaatttacatattctgttgccaccttttattaattaattaaccaaggtaatgcctcttttaaattgttcgacatgcttcaactgaaatgacaattatatttaacaccagaataacagaattgggttacttctcttggtttgactccgataatttccaattagatgtaatttcgccct

SEQ ID NO: 87 - DNA, 778 bp, Zea mays
gacgccgacgtcgatgtgcccgacggtgggccgcccgtacccatccaccgctgcatccttgccgcacgcagcgacttcttctacgacctcttcgccgctcgcggccgcgcaggggcagcgcgcggtgatgcggccgccggcgccggagtagccgcggagggggctgccagtggaaggccgcggtacaagatggaggatctcgttcccgccggccgcgtggggcgcgaggccttccaggcgtttctggggtacctgtacaccggcaagctccggccggcaccggtcgacgtggtgtcttgtgctgacccagtgtgccatcacgattcgtgcccgccggccatcaggtccgcggtcgagctcatgtacgcggcgtgtaccttcaagatccccgagctcacctcgctcttccaggtgagacgcaatttggttcttgctcgccccattgtcaataggattaaactctaatttctttaggaattgtttcgttctatgccaatactgtacatggcttcgttagactagaaatggatttgtgattttgttttctccaatccgagtgttgactacatcactacaaaaagctattaatagctgaactgctaaaattgctgaatgctgattctgttttctccaatccgagtgttgaccacatcactgcaaaaagttattaatagctgaatcgctacaattgctcaattgttgattttgttttttccaatccgagtggtgacactacaaaaaactaataatagttgaactactaaaaatggtgggctat

SEQ ID NO: 88 - DNA, 626 bp, Zea mays
caatcttgcatgcctgcagcagcagtggtggagaatgggacaacattgtctttggccgatgcccgatggtgtgtccatgggaagagggtaagggttgggcagaagcatttaggtagaggattggcgctctgataccattaaattcaggatatagctcttgaataatagattgattagaagtatacagtacatgaatatataggcaaggattccttgggtttggtttatagaagtatgaccaatcatctatcaagaggctcagggcctgtggccatgggcccaaagggcacagtccgctaagcctaacagctgcctaacatactaaattcacagtgaattgttaaaaatatatcactagaccatttactctcttttgtgaacaagttgtcgattcctctttgattggggttttatattgtaattgctttttgatcaggattttatattgtaatttagatttcatctaaactatcgtgcaggctgctgtcctcaaggaaaatatgaacattgatttgcgtgtcatgggaatagctggttctaggacaatgcttttaagtgatatgtaagtgaaaaagtggtggttttcccctatggcattttacatatgtaactctacttttatctgc

SEQ ID NO: 89 - DNA, 768 bp, Zea mays
tcccgtatagtcgacctgcaggctcattacaacatagcaagtatgtttgggaatcagaccatggcatgcatgtatgtttgggaattagaacattgtgtacatcatttggaatcatcagcaggaaaaaaagaagaaaaagtaaatgtactgcatgattagagtgataaaaagcaaggaattctccctcccgtgaaaaatagttgtcacatttgtctttgcacggttttgatattttctttcaccaccaatttcttctagaacatattctaaaaattcttgaaatcacgagattttgcaagtattttcaaacaaaaatctagacatatattaacatgtttctaaaccagataaatttgatattgatgtttgtaattttcaagttttcaccagatattatcctaaaacaacatgtatctatgaccaggagtcttttatttattcagagatagtcctaacttgtattttattttctcataaaaataacaaaaacggatgttgctttatttgcaagtagtaaactgaagagcaagtttgactgttaatttgattgaaaatattaatataaaatcacaaatgtcaagccttgcttgatatgaaaagatcaagcaataacgccatctcgtgaaaatttaaatatatagaaaaataaccaagcaattaaagctgcaagtaatacttaatctcctacattaaccgcataatttataactgctctacctggggttgtgccagcatagattccatacccaacatcatctgtgatgaaag

SEQ ID NO: 90 - DNA, 687 bp, Zea mays
aaaacagagccatcgcttctcttcaagaagcaatcttgggagctgcaagtgagacgcgcgttcgaaagaaacacaccgcttcctttgattttcctcgagacttctctttgcttccataaggtctttagcagctcgaatcctctccctctgtacaaacaagaaggagcattcgggaagatcaccacaggatacacttaagatgttagcgcgagaaagcacattttgaaaaaagagaatgcaatacctgatcctcttgtaattgactccgtatccgccctcttgccctcccttcctcgtctcgtttttgcttatatagtgctaatatcctgggaagtacagtacaggtgcgttactgggggtgaatccgtgataagcaacctaatccaaggcaaggtacacacctctttctatcttcttcctcctgcccatctgcatttggttctcgttccagctgggatgtctcctagtttaggagaaatttgtagcccatgccactcagtatgcatggtatgaagttttaagggaaatatttgatacatcaaataagaagaaactaagtacattctgtctcccagtttcagtgtgttctttaggtttctgctcctgcacagtatccctgcaagacaagtatcatccattacattctatactgcaacagcgtaccatatcaagcaacagaaatgccga

SEQ ID NO: 91 - DNA, 716 bp, Zea mays
tgctgggatttgtgcgttgtctactgttaggcagtctcggaaagcaaactggggcagctgataatctgaaacacggccagctaaagcagtagcttcagcctcaagtgaactatgtccggtaggtgtaggtggatgtgcaacatcacctagcaattgttcgatgacaggtatgaaaggcgagcctctctccccagttggcaatgaatgcctattggccaattccatagcaggctctgggtccttttcgcttgaatttggaaggttttctgccagtagaacactgttgtcccaccaatcttgcacaaagctgttagtgctaagatcaagcatcatagtttccagcagactgttgtttccactacagtccttcatgttgttttctagagtttcagcagtagcttcttcaggtgatctgttaggtaattcaggaaatgtactgttaccctggcttgtaaagtcggcagtatccttgaattgacttgagtcaccttgaacaatgaaggattcttcttgtgagaggagcctcacagattctccagggtcaggtatcagggattgttcgtgcatgagggcatggtatggtgataggcgattttcttggaatttagaagcacaagggttgctgccgaatgatacagatttacatagaaacttgtcactctcagtatgcagggcaatctttaacttttcccctgatactgctgtaaacgatgacg

SEQ ID NO: 92 - DNA, 820 bp, Zea mays
ttgcatgcctgcagctctattttgcaagtcgttactgacaacttgtaacaaattgttgtatttacgggcatttttaccatcaaatacaatacaaaaccgcatctttttttttgccattgttgtatttaccatcaaatatgatattaaactgttgtatttacaagcattgttactagtcatagtattccactatgtactcatgccaatttcagtgctaggacttctagcaacttttcctgactacatgttctaattctgtttccggtttatctgcaacaggttgttgaccttgctgagattgattgcaatcatcctattcttcatatggcgtatccggcatccgcatgccgacggaatgtggctctggtggatatccattgtcggagatttctggtttggtgtcacttggttgctaaaccaagttgcgaagctcaaccctaccaagcgtgtcccagacctttccctcttgagacaacagttcgatctccctgatggcaactctaatctccctaggcttgatgtttttatcaacaccgtcgatcccataaacgagcctatgatatacaccatgaactctatcctgtccattcttgccgtagactacccaatcgataggactgctacctacctctcggatgatggagggtccataatccattacgagggcttgcttgagacagcaaatttcgcgacactctgggttccattttgccgaaaacatagcattgagccgagagcccctgagagctattttgctgtgaagtcgcgcccatacactggaaatgtaccagatgagtttgctgatgatcatagacgcatg

SEQ ID NO: 93 - DNA, 760 bp, Zea mays
aatccagacaacaagcttcgacaaggagagaagccgcaaagccaaagtaagcctcggatcgagcacaaccagaccaaaaccgaaatgcgaaggtgaggaccgagccgaggagcgtgcgcgacggagggaacgcaaaggttaatgacaattactactactaaaattactactactaaaacgatgcttgagacgatgggaacaggggaaggaggagtccccggaggcgatggcagcggcggctcgaagggtagcgaatgcggcgagcaccgcaggcatcgtatcctcgccgggcgcccgcaacgctttatgcctcgagatccaactcggctgatcccggcgactggaaaatagcggcgaaggggaggcgacggcgatagaatccggctaccacgctccgcgcatggaccggatcacggccacggcttcgcttggctcaatttgggtcagaggagacgatgacagaggcgaggaacgggggaaccgaatcagggcgaggccgcggagaggacaacgcaagcgaggtgtggattggctgttggtgcggcgagaggccgctttgggatgtgtctttataatagtccctccgtcccaaaatagattttagcttttttatttatatttaaatggataacgatggacctaaaactacaacaaattttaatttgggactgagttattggcttctttctagaaaagttattggcgtctgaatgacaggtggaaccactccgcgtggctctcggcgacaagatagacgttt

SEQ ID NO: 94 - DNA, 770 bp, Zea mays
atagtcatacaagtggaactatcaatgagccacgtgcaaagaggaagaaactgaaatgagccatacggtttgcctccggactcaaggtaccaatagctcttattttttctagattgattgaatatacttgacacattttgctttcacaataagagtaattgtgcctgaaagtgacttgtatttttactttttttttgtatgtatgcttgcctacatatttagttgattatttacatcaccacattgtcagaatatatatattcccctactccgtccctttaaaattgtaagtcgttttagctttttaggtacataacttctgttgtacacctagaatcctagatattattatgggcatgtttggttttgacccctgacaaaaggtgccttgcccaggcagctcccaggccgtcgatttccagcacctgccctggccctggcggccggatctgcctggtcgagtgccctaggccagtgtcccaactagacatatgccctatgtctataactgattatctacgccacaaaatattgccctcattgtctatagtatatgctgatgtggactccctccattcctattgcaagttattttgggtttttcaggtatagcttttgctatgcataatgcatcaatatatatgccaacacagcaacacctgctttgcaccaagcgctaatacatctgtctcacagattggacagcgcagcgaaccggcttcatccttggtctctctgtccatgcgcgcacatgaagtcacgaaaggtgc

SEQ ID NO: 95 - DNA, 775 bp, Zea mays
gacctgcagtaaatatgatttcaattgttgttatacgacttttcaattgtccatgaatattggagaggatgccatccaaattatctgatctcagtttttttcttgaatactcatgagatgtgtatcattgcattaaggagataaataaatcacaacacacccaccattgtgtgtgtgtctctctccctcacacacaccacattctctcaggatgtattcattgtagtattatctatttctgaactagagaggccagttacatcacagcatctaaaaaatggatatcaaatagcagttctgtttgtgtaattctctgggtcatcatgttactggagattgaatctagacaatattttccttttatagggagcctaagaattctcatatgcctagaagctctcgtctaagggacaagaagaagaatgaaggtgaaagaatgatcaaagaaacatttgttggaagtgtgatagaaaacaacagttttctgagcacccttcttgacaagagttcttgtataattatcccggagattgaatttccccttccatctgttcctacaacgagggcacctgaagtctctgataagcaaggcttgattgctggtccctgtagtattagccagcaaaaagctgaggaaactcttgtttatggtgatgaaattgatgaaatcaaagaggttgagaacatgagtgaatcaaccactttctctgcatgtaaccaaagaaagttctacgaaacaaaatttggaatagttagtagtactgcattttgcttt

SEQ ID NO: 96 - DNA, 775 bp, Zea mays
tctttatcttatataagcatttcattttgaaatgatccatttcccaatgccgaggcacatgcaaactgttttaacttttatgccttacacggttgttttcagacattatgtgctgtacctatttcaggcaatttcaagacgagccaccttatacaagatgataagggattatgaccaagctgctaatgatgtaaggaagctaatctctcttcttgaaaagaaagtcaatgtgtctggagtatcaccaaaagcttttaacaagcacaatgatctcaagcaagcacatgtgaggctttcatccatagaggatgaagcaaaaaatgacacccccctgaatttgtatttaatcttgtaagttgtccaaattggttttacctttttgttccttcagtatgattttcttgccccagtttgtgcctggttgacctgaatatttgtattccttgaaagcaattattgcttatctctgcatttaattttcacctttcattgtagattttactgacccagacaacaaaaatagcattgtttattatatggatacaagtacaaaatatgctgtacttagtagccctttaaggaactacgctcttccatatgtgtgttgcaataacaatgggtttcacaataaatacaaagaaactggcagaaaaatataattttttggaactgtgtagagtgcttttaaacatgatattctgatataacaacatagaatatcttgcgtttgcagcaattacgactcttacttttcagtataagagtggtacctttt

SEQ ID NO: 97 - DNA, 773 bp, Zea mays
tatagaaggaccatggaaataacaatgcggaaaggagcagaccataggctgtgaagctgctggcacacttgctgcaaaggtacaaatctaaattagaagggtgcaaaaccaaaagccataaatggctagcatgcatggcatccacacatggcactttctccttccttcagtccttccatcttttgtaacattgacccagtctaacacaaaagtatacctgaagggactccgcatcagttgaaatcaaattggtaatcctcccagaagcaaactttctacgactatcattagttagtcgcaaagatttgcggaaaacagctgcaatctgcacaagaacaaaaggtcaaatttcaatgtaaactttgatgaccatacctaaaagaaaaattcaaaacatttaacatagaaatcatatagcgggtctgcattctagatgataaagacaaattcgcattgaactaatatcactaccaacaaaactaggtatattctatgatgttaagggggaatttgcaaaaacaatctcattatgtcattaagttccctaccaatatctacctggactaaaaggctttgtagggaatccacatgttatgacaaatctggagttttgatccccaatccaatctaagtaaaagcaagaatggtctcaagaatgtggaacgcgagatttcaattttcaaggatgcatgtttactgtacaacctcttacagaaggacaataaaagttcttcatataaaagaaacacatacccatgtggacctcaacctga

SEQ ID NO: 98 - DNA, 862 bp, Zea mays
  misc_feature (779)..(779): n is a, c, g, or t
atcgagtatgggcaaaggtggtggtggatcttgattaccatcggatgcaatgagattgtcaaactgattcgcttcttcaccgacaacatggtcaccatcagtaacaggctcagtgttctgcaacaggtgccccacttcaccttcagctggcaccccaggaacctcgtttgactgtagaggcgtcaggaattcatctgtatcttcttttttatcgaggttgtcatagtcttcttcgtcccaatccgttggtaaggaagcttccctggtagcaccatcctctttgtgggagtgataatcagggtaagattccgtggcagcagtctctgtaggcaagttttgcaattttcctgcatagagcaaagtgagcaggatagggaggctttggttcttggaaatggaatgaaaatgtacgatgtttttgctagggttaggggaaaaaaagcaaagaaagagaagagatgaataccagctgcgtgggtgctactgcttctgatagagacggcagcaaaggtaatgccggcgaggaagaaaaaggcagcaagtccaggtccaagaagccctgaggaggagctaccatatcaaaggtttagctagctagaacatgggaaagtaaagaggagaagaagatggcggatggagtgagtctcacctcctgctcggccgaaccctagagtagatttgtcggcgccgtcatccgcgctgtcggagtcggaggaccagccagcgaaggagttggcggggacgggccgggagacgctctgacggggcgcaggcgcggngtcgagaggaagaagagacccgagccaggagtggagcaagggacggccggcgaagatggtggagctggagacagcatgccatt

SEQ ID NO: 99 - DNA, 755 bp, Zea mays
aatagaaagtcgatgaaactagcacggaatcagaatatttgttcttttctgactccatcttctcattctgggctaggctgaaattttgaaggactgattggagggattcagcatcatggcgctctgtagaggaaatgctcttgtggctaggctggttgccaccccaggctttcaatattgtgtctgggtttgactcattttccagtgtggggcctaacttatctggtttattttgctgcttcagctgagagagcagggacaaggtgggttggctgttcgtagaagtaagcagcaaagagctatcttccgtcggtttgtttgctttctctctgctcaacattgtcctgaaaatgagtacaaggttgtggaatgggaattattatgactgctaagtggcaactaaaataaaaaaataatattaactagaacctcagcatactaacattattccaggatgcatgctcttaataggatgcacaagtattaaattgggattttattattcagatatcatgctaaaatagggtgccttatataaggagatgactctggtgtaagaatacagtatttacctgtttaaactatctgcccaatagctgacaatgcctggcttggagtcattaacttttgccttcttcaagctaccttgtggcccagcacatggcaatgagccagcagcagcaggcacctccttggtggtcttcttaggttgattttccacaggctttcttgaacgttgacggtttctgttgatg

SEQ ID NO: 100 - DNA, 729 bp, Zea mays
aaccattcctcgttgtttatgatccctaaattactatttccgttgcgggtgtcgctgttatactgatgaaattagcaacagaaactcatgagtttgttctgtattagtgtgtttttgtttcacgtgaattcactagattagtctactgttgccaattggattagaacgtaaaccaagtccaatttgcagagtgcttgatggctgccgcaaggggcattaaccagcttctgaagagaattctccacaaccagtccgctgtaagtgttttggtgaactctttgtttatttgcatgttgctctaaaatgcgtccatattcaatcttatgtgttttttatttccacatatccatcttgggtacaccatcacgatatggaatctatctgactggaacctattgttcatccttaaaaacaagtcgtagggaacatgcttagcctgttagaatcgacattctcaacatggagtgatgatatatcactgccgtatgtgtttcttgtgtggctcatgcttgccagttttgtcctctcctactgtatcgatttgaaccaaataacataaattatagtagtgcctcctttcacatatatatgacgccattgattttttttcaaaactttaccactcgtcttattcgaaaatgtaaaatttcaagtcacggtcaaacaaccttaagtgataaaacaaatcacaacaaaataaatggtaactcacgattttctttgaataag

SEQ ID NO: 101 - DNA, 746 bp, Zea mays
aatttgatggctcaattatattatctaggaatctcaaaaggaaatactatgtggtctacgggcggaccataccatcattgattggaggactggccagcctccgatccattaattaattaatgtaatccagatctggagaggacggccgggggcagtacagagcagagcatatgggtactccagagcgacagccaaggacgtacacgctatctagctggagtatttaatttgtttgtgatttcccccttcctctatcatatcaatggttgctcggcgtcggcgtcgttttatgcttgtgctggtgattattaagaataacgagaaagagttagaaatggctatttgacgaggttggaggagaggctgtgataaaaagttgataaaatttcgtgaaagctgtgacatatatatgatgtttataaaccgaagaatcctcaaaaaagttccatgattttatgtggaggccgacaaggtagtaaccactgtacgtacgacgatatcatgctcgataagtttcatgattttctaaatttatttatttttatatgattcaaaaacaactggactacaagtccgtggtcatgttttgtgaacagaatgttcaaaattccagtatgttcttgatacgacctcaatagtatacttaacaacatgaataaaatatagcaaatattttaaaaaaacgtgccaaaatcgaacatgtaatttccggttactatagaaacaccacagaaaaggttttgggg

SEQ ID NO: 102 - DNA, 742 bp, Zea mays
aactaactcactgccttttagtttttttttgttgattgtaattgaaacaactggacaaaaaagcatgcacatgcagagttgtgggagcgattctaccgttattcctacaaactcggacgccacgaactatattcgccacggtctccatggcacacaactggtcaccatgcactccgtggactcaggcatgcacctgaccaactcaaaacgtgacagtaaagtaaattaacagagctgagcaacaagtttatcttctgacaactaggtctgacatacatggaccctgatttttggacaggttaacggaaaccacgaaactatgaatgtggaaggtgatttccggtactgtgatccgggaggctttgatgagtgcatgcgcttccttgactacttggatgaatgtgatggcaactgggataacgcatttctcaactgggtaaatgtctgtgaaagacggaagaaagagtatgtagctttgcctaatggtgactggggtccttggaatttcgtcaaggtaaacaagaatcttgtgctggacacttgatagacaatctatatattcttgtgcttctgaaatgctggccgtccgatattgttacagaagcagaaaggctttgctgcaagatcatctcttctcaagcgaggtggtccgctagctcgtgaattggctcggcatcctgttgtcctcaagatcaatgactggattttttgtcatggtggccctcttcctcaccatggtgag

SEQ ID NO: 103 - DNA, 856 bp, Zea mays
agcttgcatgcctgcagtagcttgcattcttctatacattgtaagttcgcttcccatttggattactggaatgcacatctccttgtatccagaatgtttttgacgattcattttacccataatccaggagtacaagcacattgccaggttgaagctccttcatcttacaagcgcaacaccaaaaccaaaccattttacagttcttgttcgtggaataccaaaggcagataaagaatcatgcagtgatgttgttgataatttcttcacaaagtatcactcatctagttatctcttccatcaagtagtttacaaagtcgggaaagttcagaagataatggtacttaacactcaaatgcatttcactttttctaatgacaagcatttactagtataaacctgtttcttctgttgattagattttcgcacatatggataatcatttttttttgtattttgacatgaatccgtggaaatgtctgcatttgtttttttggtggtggtggagtggaagttatgcatatttctatttcactttatttatgttttttgtgttactttaatcttcatctctgacagactggcgcaaagaaggcatataagaagttcaaacatttcacagatgaaactgtcgatcaaggttgcaggacagttacctaccgctgttgtctgtgtggagcttcttcaaattctttcaagttgttgaacactgagtgtgagcagaacaaggggaaagcggacaataaatccatcttggacttagacgatgaggttaagcttgcatgcatttgttcttttgcttaacctatcagttatttagaataattagtaattatcgtgtgggattgaatgcaggatg

SEQ ID NO: 104 - DNA, 773 bp, Zea mays
  misc_feature (748)..(748): n is a, c, g, or t
gcagaagcttctctaaccttaaaactatcaaaaagaaagacaaaaaaaacaaaagagactccaaacactgtgctgtccatgcatgtttcggattctgtccaaatcttactttcaccaaagctgagcacatttattcctactaccgctggcaagtaagtgaaacgccgattaaaactagatggtgacaccgcgatgaagatcagaaattgtttagcttttgaagaagccggtgggcggtggcacgtagcaagtgaaaacaaatggagattttggaagcacgaacgaaaaggttcacgctaatctgccagttcacacagtaatcatgagcatatttgttctcttccccccgcaaagcaacaaatcgaactccctactcccgagtgcatccaaaaataaagggaagatgcgagagaaaatgcttcacacacggcatgcactactcacctccgccaccatgccactccagggcagcgccgccgccgctggccgggaccagcgccggcggatcgaccttgatgacgtcatgcagctcgcgcagcatcttctcgaggctcgccgcgttctgatgatccggcagcgctgcgccaccacctccatgtgcggtggcggcggccgaggccggcggcgtcggttgggcgtattggtttgaagggagctccaccactctggggcaaggggacggcgagagcggcgggagcctgctctggtcggcgccggcgctgcgcgcgccgtagccgagggacaggtnctgcgtcgtcggggacacgggcgaa

SEQ ID NO: 105 - DNA, 863 bp, Zea mays
cactcttgcatgcctgcaggttccgttcagtttgtgacgtgttcatcccacttatcttaaaacaacagaacgttaaccttaaagcatggcctaacgtggttggttgttcggttgctttaagattagggcgatggactcgtgtcacgaattgaacggagactgcgtgtcgcttctatgcagctggttgttggtatggtatcccccaataagcccctaatcattccccgcacggatcacaccacatatgtttgggcacttcctgttcctggggtcctcgcccacgtaggctaacaacgcaagcattgtaccgaaaaccccaggcatcagatgctccaatctttgctgcccatacataggccgcctctagagagcaaaaaagagaagtgcaaacaaagatcctcaaaaggacaggcagccaaatgccccaccacagcgtagcccctcctcactgactcacctgcaaaaaccacttgcaaaccacacaaaccgaaaccgccagctcccctgcctccatttttagcaacttttcccttcaatctcccgtcgcagtcacccttcttgcacccccgcgcagcttccgacacctccgaccttctctggcggcgccccgccgttggacgctcatggagaagagcccgggcgccgcgccgacatcatcgcccgaggaggaggtggcggcggatggccgcgggcacgttgaggacgcgacggggcagaaggagcaggcgacgcccgtggtgctcaagaaggggccgtggacggcagcggaggatgccatgctcatggaccacgtccggcaccacggcgaggggaactggaacgcagtgcagagggtgacccgcctgctgcgctgcggcaagagc

SEQ ID NO: 106 - DNA, 817 bp, Zea mays
agcttgcatgcctgcagtgccgaatacagaagataatgtttagctctcaaaggaacagcaccagaacaaggatttaatcacagcaaacaagacttacctgtctacaagcaactgtatgcaatcttccactttaccaagcatgaaaaggcagaggaaagcaacattgttttttccatgttcttttgccaaagaagcaagcttttcaattccttcagcatctccaagagatgaatacaatagcaacaagccacttaaatccttcgcttgaagaaggcattcctccgccatctctagctgcaaggtagagttatggcatacccacaccaataagttatcattcacaagctagtacagataggatatgttcgatttaggtcatgtctcaattgacatcattcccattcacatggagagttctagccagaaaaacatgttcagttgaagttttgagaagataaaaggccctaaaccaaaactgtttgatcacaaaagaataaatgtcacactgtagaaaaggtattccatcctcaaaaacttatttcctagcaatgtagttatttaaatgccaaatacaaacttccgtaaggttcacaaaccaaccttgcctgtggacatggcgagttcacccaactgcttccatttagattcactctgtgcttctatgacgatagcctgaacagtaaataggaatgagaggtcttataatatactacatccgttctcgaatatttgtcgcccgctagctcatttttgaactaaaccgcgacaaataaaaaagaacggaaggagtatgttactttgtaatttgtagcaatgg

SEQ ID NO: 107 - DNA, 800 bp, Zea mays
acccggggaccctctagagtctacctgcagctgtataaaattttcaggcaagaaagttcacttactaagcaaggtacactcttgctgaaacacactgatgcttttgctcgaatccgtggattcctgttcttgaggtagggctgcattcttggtaacagaagtaaaggggagatccaacttgtcatcgatgtaagagctgcctcagcagcttcacagacaaaacgcttatcttgtgaagcctttagaaacagctgcactagctgtgaatgcagcagttgacagaaaggtattttcaaagaccttttagctaatacaagaaattttaaatgaatagcgatactcaccagtggatcaatagactcaaccagtaggtcaccataggccttaaagatgtcagcacaagtcatcagtgctgttttgcatacagcacttcttgggttcttcacagatttcacgataagaggaactagaggctccctgcattcaaacagtttgtgctaaacaattagcaaaggagatatgatattctctgtcattggcatggataagtggttccaaaagatatgtgaagaattttccaacggggaaacacatttcttgtgcatataatatgatggaaacaacttacagcagctcctgcaatctttccttgtgatacatcgccaactgacgaacattgttgagagcttcacatgtcataacccagtcctttgaatccaaccttttaactaaggtctgttgaaaaagtagaaacaataaaacttagctttgactagaactaaaacaaagagaaaccaatc

SEQ ID NO: 108 - DNA, 805 bp, Zea mays
ccccggtatcctatttagtcgacctgcagaccatatatgtttatggcatgccaatatctagtaggaacttagtaatagaaacgaataaattgccttcttagttttaagaataaaagttggtgcataacatgcagccgctggaacaaagttttggctcaaagtcatatggtattgtgaaagcatcactaatatctagggaaatacttcttgaagaagtgaagaagatcagtaatgctgttggtagcactcttgaggatttggatcgcactgacttaacccttggtaaatatgagacagttcaaccatcaaagtcagcttcgcccagttacagttatgggcaaggtacgcccacaaagtgtagtccccagatgactggcatcttacgtgattttcttgaggtatacttcacttttttttctgaaaaacgttttctatctttttgaatatctgtattggttgatgcatctcaaacttgtttcagagttctggggttgtggttggaagcactgatgatatcttgctgtatactctatctgaggaagaattgtttgaactatttcaaattgtcagcagccaactctcatttatatggaatgagttcttgaaattccataggttagttatcttcccatgcatctcgttttagaagatgggtgtatccattgattgggtgtttcttattcttatgggtctttagttataaacatataatgactctttaataataatatttttttttcaaaaaggtgcaagagagttgccacaattcattaataagagggagaagcaaagcaaaccaaaaagc

SEQ ID NO: 109 - DNA, 729 bp, Zea mays
tttggaccattttgtttctttgatttagatactgaagcattactgaatatattcataagacaacgccatctgaaaacataacatggcctttgtttaaattttgattttgaccatttcatatggaatattggtttgatcacaaatacatgatcttcacataactcctctaagaatgtgatcttcatgtggaaactgctatcgccatgacttggcagagattgtcgatcttccttcagccatgcttggtgctggacagctggaagcgacaaacagaccaagttgttcatccgatgtcgaagccagaggagtttcaggaaaatcggcttatgtttatgttttattgttatgtcattggacgagtgtgtatcaggataaatgtagaaaaaaagaattttttttcttaaaatttggtcatgtactcaattatttctttgccgcaggaatatcatggagcatatgtgctcttcctggttgatggactggttctacctttactgcctctgcctgagcccccacctcatgcctggtccatctccaggagttcactgtccaccacggcatctgtgcacatggaaacgaccacctcgtgaccgatgtcttacttttacgatcaacactgcatcctcgtaccctgcctgatcaccattccttcgccaatccaaccatgccaatctcatgtctggctggagagtggagataagtgggagggttgcaccaccaattccttga

SEQ ID NO: 110 - DNA, 734 bp, Zea mays
ttgcatgcctgcagagatttgttttcagcaatgaagaattcaccataaggatcgtcaataactccctcatacacccacctaacatggccgaaaacaaattcacataatagcatgagcactaggactctaaacaagacatgacaataattaaaggatgtgtgttgagtattgacttcagcttaaacgtgaaagctagcaaagacaaacaaggaaagaagctatggacaatcatgaacctttctagcatcctgaggtatgctgcacttgcatattctgtcatcttctccagtaaagaccgaacaacactatcaccacccatcgcctttgcctgagttgaaggatatgatagatgcattacatgtttaaataagtataatgtgaattcgggaaaactaagctctgagaaaaatgtgaagtaagaaaccaatccaattgaagaaaatcgttttatctataagaaaattaaaaactggactgctatatttatcttatatttacagtaagcagacaggaggagggaggaggcacagaaggaacagtgtgtaatctcagaggcataaactcatttgagggagtacctggctttgaagtagattaagtgtcgctgaaccattagtattgttggaggtagccttctccactagaactgccagtgcattcagtgaactcatcatcctctgccaaagagaaaacataacttttaatgctaaaaccaataatcaaagaaaaggcaa

SEQ ID NO: 111 - DNA, 718 bp, Zea mays
aactgctccaaggacgtggtgtcgtctgtgtgcttgggtatcaggtttatgttagccgacacgctcagattgagcagcgtttccatcgggtacccggcaccgttggcggtaaggttagcgaagtggtttgtcttgagtatcctctcgatcgtctgaatcccgtagacgcagcgcctgaggtcctgtggatgctggaagtagttgaagctcacgctggggttgctatcgatgtcggtgtccgcaagcaccagactgccagtcgacattgggccatcgatcttctcaagaatgaatcctccgtcaaacacttctttgggcaggctatgtttgttacgcacgtactcttggatttgatcaagacttctttgctttggtggaattgtagatatctgtccaatctgcgatgaatggagactttatatatgcatgtagaagatgaagaaaagaagaagacgacgacgacgaccaacctcagcagacatgattccatggtggcaatggatgctatcgtcggactggctgaaaccactgctggcttcaataaacaccccagcgtccgttatcccgacagtttcaatcaaggactgcttcgtggggctcttcataggcacgaagatggagttcatcggattgtccgacatcccttccccgacgtgttcgttggcgtgcaccagaaaaacgttgtgcctgctgagttgacccctcggcccgatcccgt

SEQ ID NO: 112 - DNA, 787 bp, Zea mays
catcttgcatgcctgcagcacaacatgcatctattttctaaaggaattatgttgcccgaacctgtcttctagcatatacttgtctgccattataggtacaagtattaaaatggaaccagatatgtctgttaacttcttactgtcctatatggctcatttcctctgttctaaactcttcagttttatatgttattacagatcatgaaaagggcgtcggagactctaatacctgtaactctggagcttggtggcaaagattcatttattgtgtgtgaagatgtagatttacccagtgtaagggagtctatgttgcctatgcatgaacattatattttcttaatcctaacagtgtactgaacctaatttgtcgtcttttcctgtttgaaggttgttcaagttgctactagagctgctctgcaatctagtgggcagaattgcgctggtgctgaaagattttatgttcacgatgacatctattctgcctttgtttcacagatagtgaagacagtcaaatctataagtgttgtaagtacacagccatattttgcagccaactaccttgccccaatttatcactttactactggtttacaggaccacaaccttgtgttggcatttctgcattattatctgttattgctatgtcttataaacaagtgtaaatctgtgaattaactaatgagactgggtgcattttcacatttctaacctctttattttttcatattggggttgtttttcaaggtttacatgaaaaatttgttagttaatggttatctaaaattta

SEQ ID NO: 113 - DNA, 766 bp, Zea mays
atttattatttggtcgctgatgtgatgaacaactcgtctgcctcaggcttccacgtccgagtggatccgagctggtcacgcatgaggcaagcactccctctcgcgtacagtacgcagatcatccacctgtccagccccggcgccagccagcacgaccagaccacgctctccctctcgccggtgccgaacactaggcaggcaggcaggcacggtcaaccagtcccgcccaaccaaactctccagggatacggctctctctccctctcggtctgtctggtctgcatgtccacatctggagctccacggccacggagatgcttgcggttgcggaagggagctgggctggaggccgcctcgcgttccacacttccgcgaacgtgctgccgcgacgggcgcacgaaagagggacggagaagtgtgccgctcggtccagcccacgcccgctcccccccgcgctataagtagcggcccggtccgccgagtcgagccgtccacagcagagtagagtagcacacgcactcgcctcttgtgtctttctttgggagctgtggtcgagacacacacagcagcagcagcagcaacaacatacatgcacgctagcctcgcctcctacgccgaggcagctatgccggcgctggacctacgccccgagatagcgcacgcgcaccagcccgtcatgtcgccctctcaccacggctgggacggcaatggcgcccgaaccgtgcccacaccgatgcccaagaagtactactcactagctactctg

SEQ ID NO: 114 - DNA, 667 bp, Zea mays
tttgcatgcctgcaggcagtgcctgggcagcgccgagaagccctccacgccgaggatggccatgttgcggtagatgagcgcgtagggggccttccagtacccgtccggctcgcccacgtcgaacgccctgtagaagagcatgaaggtgagcggcgccaggacgcaccccatcagcgtgcccacggcctgccccaccagcatcgaccgcggcgacgtcagcgtcaggtgccccgtcttgaagtcgtgcatcaggtcggccgacacgagcaccagctgcttcaccagcccgcaccccaccagcccggccaccacgccgctgtccttccccgcccacgccgccagcacgaacagcgcgatcttcccgtagttgtaccccatgttcatgtccgtcagcccggtcccgtacgcgttgcagaaccccagcgccggcgccagcgcgtacgccaccaccacgtagtaccacctcacctcccggaacatgatcgggatggcgatcaccgcgatcaggctcagcgcggcgtaccccgcgtaggacagccacgtcgggatgttgtccctgttgaacacctcgtcgcgctgcatgtcgtccagcgccatcgtgtccgcgtccgccactgcgcagtataaattccaactcccgatatagtaagggcttggttggaagagg

SEQ ID NO: 115 - DNA, 828 bp, Zea mays
gcagcttgggtgctgcttaaacccgtaaagcaagctacagtcacttggactcttcatcttcatatgtaggatctctgctagttctgtcgtactgaaatcatcgaaatagaagaatttcgtgacccgcctgcagaagccatcattcgaggcaatgactcgcttcattggctcgcagtacccagcaaatacgacaactatcttgccactgtccattacagacattatctcctccaaggcttctaaaccataatccttgtcatcggatttttgcattggtatcaacctgtaagcttcatccacgaagagaatacctccctctgcatcatgtatctgttgtcgtggtcacggtaacaatgtatgcgtaaggtagaacacagaatagaaataagttcagaacttgtttcgcaatttccctgaaactgaaatttgtgcagctgacggagcctttctgatgaaaagaaaagagaggattaataccttcctcctagtctttggtccagtatgccccacaaattctccaacaagatcagttcgctgaacttcagttactttgtcagtagggagaattccaaccatgtggaggagctttccaagaattcgagcaaccatagttttgcctgcaatagaggatagataatataaacagagcattgatgttttcagtaactatctacccagcacttgtgcattttactgcactgtacatgtaactgcaaaatgtataagaagcaggcagaattagaaagaatgtagccttttaaggacatgtttagccaaacttccaggtaactaatttccgttcatgatcagatcaaaagctcccaacac

SEQ ID NO: 116 - DNA, 768 bp, Zea mays
cttgcatgcctgcagtacccccaccgcctacacctgctgccccgccaaaggcgtcgcctatacgcccccctgcggccgcgtcgccacccccatccaatctgccagcgcccaacccgccggcggacccaacgccgccgacagtagcacagccacctccgccacggcgccggccaccaagatcgcctcagacagaacctccacccctggcaccaccaccttctggaattcctgtcgaaccttccccaaccagtccctcaccgacgtccgcagatccttcgatccccactccctctagcccctcgtctccagggacgacaccgtccacaccaggctctgatggcactccatcggtgccagccccagcaacgccaggtgactcagttagcccggtaacaaccgggggccaaggttccaacaagtcgtcgagtccagcctcgcagagcagcagctcctcagtagacagtggtggactgtcttctggtgcaaaggcaggcattggggtagtcgttgccattcttgtgcttagtttggttggagcagcattttggtacaagaagaaacggaggagagtgcatggataccatgctggttttgtaatgccttcaccggcctcgactcctacacaagtgttaggtaattctcatttgataaagtgcatttgcagcaattacacgtctggaaagtcaagattagtctttatatgtacctgagtcatgaaatgaactaaaactcatttcttgtttagggtattcggccaaaacaaacttt

SEQ ID NO: 117 - DNA, 1295 bp, Zea mays
gccacagccgcaacctgctgcactggacgctgcgccaggaagccacgtgcagccgcttacagtcatgttgccgccgctgatcggcagtcagactccacctttgccgcgagtagatcacggagctagaggatagcagatcgggcctgctccaaatatacacgtggtaggcgggcttgaaagcggtcctggtagtcgaccaccgagcccgttcggcggcatgcagcaagctcgtcgagcgggtttgaacgcacgggggtccgaagcgcaggttcaggagttcggagaagcggcgccatgatggagtgccctcatcttgctgtatttggatgaaccacagctaggcgacatcgtcgaggttgtaggaggccattcacacgcgttcctcgtcgatgatgcgttgttgatggaagtaggactcacatcgattaaggaacaccaatgaatcagttttgccatcatactttgggaagtccaacttctggaaccgtgggggtcaatcctggtgatgatcgccagacgccggtgtgttgtcccttcccggcttcccgcccagggcagaggactcgattcgatggtcctactggagttcggtgaccgacaacttgagggattctacagttgctacaagggattgcatgatggtgactaggtcggatgtgttgggttccgccatagcagccatagcagaggttgatgaggttgcgtcgaatggtggtgaagagatggatttaggtgacagaagtggtggagaggatgacctggaatctgataccagatgttatggatcctagttcataaggggataaacagcgccaagaagatagatgggtggagtcagcttgggagagactagagtattagagaggtctggaactaattcttctttattgattgattcccccttaggagatacaactcacctttatatagatagaaagacttggcccccaagtaactaactcaattttatctaatctaattccaagtaactaactcaatcttatctaatctaataccatataactaacttaattttatctaatctaatctttatccactaatcctaatcatgagcctatccctacaggcctccatgctcagggctgccgccccatggcaaacgatttacaggattttggttaatggccaaatctcggcatcagtatttgcatagcgctgaaccaggatcctgaaacccaatatcaggcttgaagggtgtgaaactgtgtatggtgtggtttttagtaacctgaccaatctttgtgacagcataaagcagatacaaagtgatgcag

SEQ ID NO: 118 - DNA, 763 bp, Zea mays
attttgcaatgcttgtcctgttttctttgcctcagtaagttgtatctttgtatattttgctttgccagatacaggctgtaaaatgtaggcatgctttttcgaagcagatctggaaccatcctgctcctgaaactcaaaaacctgaaaatgtagtttacaaaccaataaatatttgttaggttgctggatgcaagcaacagaagaataaaagatcccaacaaaacctcattacagcactgcgtctattcacactctaccacatgttttttcaaacagaaattgacaaaggtaattgtctccatgccaatttattctctcaaacccagggtatttatttgcgcacaaacaaaattgggaggcacctgactccactctgatggaagtaaatcctcccagggtttatccacaatccaaggactgctatcagagtcaaaatacaccgccagactctcaagttcaacagactgcaaaatgccaagttaaagaagtcacgcaaattgatcaaaagtaaaaaaggtcaaactaaaacaaataagcacaccaaatgtgaaaaatgcttgatgtgtgaagcgaaaagaattcattactaggtcctgaaaactttaaatcaaattaattgatcgccaaaattagaaaataaaaaatgagctattgttattttttactttcaaatctaatattcgactaagtagacaatgagcaatcaccatttcttggagatggaagatagatttatcaaggaaatgccagaagaataggcatt

SEQ ID NO: 119 - DNA, 805 bp, Zea mays
tacttgcgcccagatttgtaagcatcaacgattcttcgatgcaactaatgcccgttcttcttcactctgaacttttgatccccttttgaagctgaatgagaagctgtcagttaagaagccttctggtcaaattaagttgaaagttctaaaggatatatcaaaagagcatcagattgtttgggataccactaagagtgagcaggagcttttgaaagttgacctcctgaagagttgattatatgcacggctgaacctctattgtgctgagatcaaagcttgtcaattctagtattaaagattagcgtcgctggttttacattaaaattagaaatatatactcaatatttacattttcatcttattataaaattagtggaagcactggtagagtagatttttggaagcacggttagtattacatattcccttgaaattattagtctatacttgatttgagattttaagtgaactttagaagtttataatggtacacaggcttcgattccaggctggctccaccactggaaatggcggcactggtgccggagtgggctaccaaggagccctgcctcatggggatcgatgaggctggccgtggccctgtccttggtaaacgcttgcctctcttgtgatcggttaatatccatgttgcttcaaacttttttgagttttgttactgtattttatgtataaatgttcagttggccaaagtgaaataggatgagcactcatcctatttgtgcaaatgtgcttgaaattctagttggtttcgacgcatttcccaagcaaatgtcatgagggatga

SEQ ID NO: 120 - DNA, 775 bp, Zea mays
cggtacgtgaacgccaccagggatccttggaccgtcctcaacgacttgatccttcggttccttagaacgaggacggtagccagaacgatggcggtgactgcggcgacgaaggaggagcccgcgacgacgagcccgatgatcagtttcttggtgttcccgttgctagagaactcggaggcagcgaggcggatcgagatgctgccgcctccggtgccactgccagcgctcgtcgtgtcctgaaggttgatgaggtccccataccacagcgagcagccgccgctgtaggagtaagcggtgcaagagcagttgcggaggcacgcgagctcgcagtcgtgagcgctcgcggccgccgcgctccgcgcgtcgctcggcagcctcacgtcgggcatcgtgtagaacctatcgtcgtccctgcggcgcttctgcccgtctcgagcggcggcgccggcgccgcaaggctggagtgcggtgttcctggcgcatcccgcggtgtggtcgtcctgcatccactcggccaggtcgcgctcccggaacccccgggggcaggtgcaggacggcagcgcgttctcggtgcacaggccgaagggcccgcacaccgcgtacacgtcgcactgccgcttgggctccgaccagaagagcacccactgggcggcggcccgccacccacgtgaggaactggatctgccccgtcacgtccacctggaaccgcgtcaccaccgactcgttcgcgacgtcgtaagtgaagtagctcttgttggcgccgtcgacgtagccg

SEQ ID NO: 121 - DNA, 855 bp, Zea mays
accggaatttgcagcaaatttatctttctgtacccctgttacagctgaggtcacagcagaaccaaactggccacccattgaactgcctgataactctccagatttcgaggacactggagactgaatcacaggcccagtaggggcacgagagctaggtgctaactttcttctctgaattatgtcttcttttttgaagtccttctcagctgcgaaccgagtattttgccactgtcccatgtttggaacattatttcttgccactgattgttgtggtaaatgttgagattgggattgctgctgatccagcatggaagtttcaggtgccatagactgcaaggcgtcttttgacttatcagaaccatccatctgctcctgcttagcatcgtatctcaaattttgctgatgactaaaatataaggaagatcctggatcttgcatgttgttcatcatcgaagaaggatatctctgaccactcagtgaagatgcatactgcatccccttgacatctaattgtggatgcagttgatggttcttccattgcatctcctgcccaccaaggggttgaggccttatctgctgctgctgtacatcatcaataccaccagttcgctttattctcttaggatcttgaagcgaggcatcctgcatttccctcttcacagatagaaggctgttggcagccacagagtcactgtaaccaatcaagctctgatgagatgaaatgcatgaactggttccaagaaaaatggcagggggtcctgccatatgatcattaccagcagcagaataacataaggtttgctgtaaaccaaattgaggcaaaaacgttctggcaggcatcttgtggaagaaata

SEQ ID NO: 122 - DNA, 764 bp, Zea mays
tatcgaagctgggaggctacctggcgatatttttgatgagataccaagcaagtactataatggatcagttgtttgtgaggtaagttgttttatcacacataagaaaggctatgcatgcaatgctattgaactgcaacatgctgaaacctttctgaaatttattctcttataaattgtggttggtttctctgatacatggttcaaaaagcatgctggtacaatttctgtactgaggatttatgctatatgggagaaatccttctttaaaagaaaaactagaagtttggtgagctttactgccgacatgttctataatatgccaacctaccagtactgtaccaacctttttctaacacttatttcagaaacaaccgttatgcattatcatgaagcatcatgttgtgtcatgtgctcatggtcatgtgctactgtaccttattgataagagaccattgagtctttagcagtacttcattgtcttacatcgacataagtaatgagttctctttctagatacatgactaccgaaagcatgtgtccaaccaagcgcctgcatcatctgctgagctaggatcaccaattgtgaataaagtacgactgcgaatgacctttgaaaatgttgtaaaggacattacccttctatctgatgattcctggagttacagagattttatggtaagtatgctgtggtaacatctattctatgagttagaatctcaacatggctcattttggcatctgtacctcgtagtctttatactcta

SEQ ID NO: 123 - DNA, 768 bp, Zea mays
aggtctgacgggggcgaggtagtagttgttggcgatgtcgtccgacccggcgcagacaaggaacaggctttcggccacgatgcctgcggcggcggcctcgtctccgacgacccctgcgagcctctccttgtactccgcgaacatgttgagctcctcctgcatcggcagaactgcctgaagaatggcatttcaacgggggtcgttcgtttgttgtttaccacgagagtggaggtgagcgggtcgtagccggtgcccccagacgcgaagctgacgcccgtgcagaggtcgtcgtcgctgaggtcggtgccgagatacgccggaaccagatctttcaagccgagccgtgaagctgcacaggcatccatacagcgactgttcgttaattaggctcgtgctcgagtcagcatcgcagctagcggcgcgggacacgaacctacgaagtccgtcggaatcctgccgttggagaagcgtccggtggggacgccgccgttgaggtccttgccgtatggcctgaagttggacttggtgagcgtgaggacggcgttgttgttgcccgtgtccacgatggagtcgccgaacaccaggatggccggcacccgcggcctgccgccgccaaccgccctggcctgctgcaatggcgacgcggcgagcacgagcagcagcagcagcagcgacattgcggtaccgccgagctccatgagctgtatccctaaccactggaggtacggttccattctcgccactgtggcaggctgattgggataagta

SEQ ID NO: 124 - DNA, 737 bp, Zea mays
ttaattgcgcgaaagcgtactgtttgctacatgcgcgagggcatttaatcccagcacatgcatggtacaccacaccttcaccctcaataccgatgatgttcacaaatcacagcagcggcagcacaatgacagttcctagcacatccacagtggaatttcatttccattgcccacgcatgtgggtgttaataagaaagggagagagggagagagagaaaaaaaaagaaggttctgaaatgaaagctaaagcgcttgaatacacaagctcccaggctcgagattgtttcagagagcaaacaaggccgatcacagcagcttggggaggtttacagcgtccagagatcagacttaccataaacagattcaatgaaccccccgggcattcgtctcatcgccttttcttcgtggtcgcatttgaagtcggggcaaaattctgctcggtaaccatctttataagattcacaagggaccgcaacctgtcccacacgctatagccatacagagtctccacaagcaactgctggaactcaaatccatgctctgagacgggatactgcaaaaacaatacgaaaatttgataagcagtcgaataccatagcagagccacaagaaccaagtaaaccatgcaaatcaagagtacttgtatcatggggactggggaagaagtagacctggataggcttcgggatcactgttctaatatatgggcacaatctatcttctacaacagactttaa

SEQ ID NO: 125 - DNA, 789 bp, Zea mays
aggctcaacaatgaccactgagggcactgaagtcgcttgatgtgctgaattgttcgtgatgttggtggcgtattttgtttaaataagtaagcatggctgtgattttatcatatgatcgatctttggggttttatttaacacattgtaaaatgtgtatctattaataactcaatgtataagatgtgttcattcttcggttgccatagatctgcttatttgacctgtgatgttttgactcccaaaaccaaaatcacaactcaataaactcatggaatatgtccacctgtttcttgaagagttcatctaccattccagttggcatttatcagtgttgcagcggcgctgtgctttgtaacataacaattgttcaggcattatatccaaatctagaggcctaccaaaatgagataacaagccaactaatctgctgggaaataggtaacaagtctctaacaagatcttaagcttattctgagatgatgtcgagaccgatgccttttgttacgtcgtgccgtgcctcttgttgccatgctggtaagttgctgcctcttgatgagggcaagctgcttatcaaggcgggatgaagtgttatggacgcaggcatgggtgctgctagcttggcatccagggttccaggataacccatctacctgcattagtttgtttagtttcttaactgctaagttggcagatcaagttagttagacaagattgctagtttcctgcttggtttgtagttcatcatgtacgaaggccaggcttatgtatgccaagtgtattaatgtgtta

SEQ ID NO: 126 - DNA, 767 bp, Zea mays
cttgcatgcctgcagcttaggcatctaggtctggttgctagatttggtattctacttttggcgattggaatggccggtgattggatcttgtgcagatctaacgtccagtgctgatctggtgaagtaaactagtaaagtggcacacctacctacccgataggaaatggagtggccctgtttgcgcaaaacatacagaatttaccccgtcctccttgccagcctcaatgccttgatattgccacctgaagtaaagaggactcacttgctctagagctcatatagatatgttaacatccctgtgctttgcatatgagatgttagatgatattaagcgtatatacgctctcgttccttatatatgtccagtgaacgttttcattttgttttttgcttattttcttccatcacactgatcatgttgattatatgcttcttaggctcttgtcaatatgatcagcaaccctgtcaactccactgtcccgattgcggcggaggttttcaagaaggctggtacttatgatgagaagaagctgtttggtgtgactactcttgatgttgttcgtgctaaaactttttatgctggaaaagcgggtgtgccagttactggtaataatatcatgtcttagttgacagtagacattgagattatgggtcagcattaacttctcatctcccttgacatgacttattgctgtgcccttttgcaggggtgaatgttcctgttgttggaggccatgcgggtattactattctgccactcttctcgc

SEQ ID NO: 127 - DNA, 751 bp, Zea mays
agggttttagttatccaggcatacccccagcgcctcaggatgccgcaacgcctaaaaaaccaaggaatcgcagcagcttgggctgaaaatttatatttgtgcttaggatgatgcatctcggataattggtgctactgacagtgactcaagaaaccgaactggtcctactcaaaaggccatttcattgccttcttcgcctcatgaatataggggtcaagatacccaaaaaggtgatgattttataagtaaagagaagatggcattggcatggaacaaagttttccagagctccccatttcttaataagcccttgctgccgtttgaggaatggaacatagatttctctgagataacaattggcacgcgggttggaataggcaagtaaccttgatcttcctcagctatattcactaaactctacagtgtccttattatagcttatatgctcaatatcgaagtatcatattcttgtattgccaaatatttttttaaatatgctgcaaaacctgtttagtgcttctattatggtgtgctctctttttgctatgttgttcactataatttcattgttgttatctcatatttcattattctgcttagaaatggcacaattcttttctggttgtcttttgctatttttggtcctgattatagcctaacaagctatagcttgtttactgaaatgtttcatcaggattcttcggagaagtttccgtggatatggaatggaaccgatgttgccatcaaagta

SEQ ID NO: 128 - DNA, 688 bp, Zea mays
atcttcgctgggttctccaccatggatcgtccaacgcgccttgtgcacctcgccattgcgggcttctccctccggattgcatgtttggctgtggtcgctgtcttcgtgctggcggcgtaccttgccttcgctccaatcgatccgcacatcgccgctgcggcatgtgtgctcccgcttctcgcggtttcgccgcaactcctcacacccttcatcatcctggtactccatgaacaggcacttcttagaaggcttttccaaaagcacgcatcgcccaaacttcgcattgcattgcaagtcgcaaggggattcttccagaaccacatatctccaatagtcggatgtatcaaagccaagctcccacaaagcctctcagccatcataacagatctagttcccagacttaacagttgctgcgtcagatcctcaatttttgtatgcttagcccctattttggcagctatcttaacagtggctacggtgattggcgtcattgccatcatctgcggcattattgctgctatagttttcgctataatccacttcgttactgattaagtgttttcgatcataatagatgtgcttattgtaataaatcgtatttttaacttgctctcaaaataatagaaacatcatttgttttgaattacttaaagatggatgtatattgtatagtccgttctgaatcaga

SEQ ID NO: 129 - DNA, 755 bp, Zea mays
agccatgtcgtcgtcgtcgtccacggcagcgaacatctccgagcgtccgatctctccggacaccacccgcgtggcctgggtggggacgggcgtcatgggccagtcaatggccggccacctcctcgccgccggctacgctctcaccgtcttcaaccggacggcatccaagacccagggccttgtctcccgcggcgccagcctcgcggacagcccgcgcgcggccgccgcggctgccgatgtcatcttcctcatggtcggtttcccctccgacgtccgctccaccgccctcgatccatccacaggcgccctctctggcctcaccccaggcggtatcctagtcgacatgaccacctccgaccccaccctcgccgccgagatagccgcggccgcggccgccgccggctgctcggccgtcgacgcccccgtctccggcggtgaccgaggggcccgcaacgccaccctatccatcttcgctggcggcgacgccgccgtcgttgctcgcctggcgccgctcttcaagctcatgggaaacgcgctgtacatgggcgggcccggcgcggggcagcgcgcgaagctgggcaaccagatcgccatcgcatccaccatggtagggctcgtggagggcatggtgtacgcgcacaaggccgggcttggacgtggccaagtggctggaggccatctccaccggcgcagcggggtccaagtcgctggagctgtatgggaagcggatcctggagagggatatggcggcttgc

SEQ ID NO: 130 - DNA, 790 bp, Zea mays
tgcatgcctgcagcattggctgtgaacctaccaaccatgtggtcttctcttgtcttttctgtcagcgttagtgcctgtacaaaataatattatgttacgagtccagggtgcagagcatcatccagcatttcagctacgtgttgctttccttctaaaatttagacaagtgggttgttgaagagggttttttaatgcactagatctaatagttattgactaaaattaattgagacatctaaacattctagctaatagttcagttattagctattttttataaattattagttaatagtaggtagctatttatcagctagctaattctattaacaatttttaaccaactaactattagttctatgcatttaaacaccctctaagttaaactggagaacaaaagccgttgttttgtcgtggtcaacgaatgcttcatccgaccttgtggtcatgaaagctttaaatcctcaactggccttctcaagtaagagacagacatcgcatctgcatatatggttgagatctgagatgcatgcacgtggtgaggtacatgtgctgcatctgttctgttcaaggtctgaaatatagttgtggcacaaatctgaaaacactgaggccccgtttgtttcgctggaattgaatttcactttaataattataatttagacaaaactaattaagtttatatatttatatatgtaatatatttatatattattctaaatcatatgagagatattatatactacatttatgttatagcaaagttagtagaatattgtgatataagtgt

SEQ ID NO: 131 - DNA, 729 bp, Zea mays
gtcgaacgagtctgtcttcagctcaggaaccacaacggacagaatcggcatggatggcctatacttggctacaagcctagcagtagttcctcccctggtcaggaccaagataagtgctgccctggcagagtttgctgtgcgaacagctgatgatgcaaggctctccaatggactcattggaattggagctgaagccatgattgatttgaaaatagcagcatggtctacgcaagactctgcttgcaggcagatcttagccatagtctgcaccgccaactctggataggccccagcagcagtctcaccactgagcataacacagtctgtgccatcaagaactgcgtttgcaacatccgttgcttctgcccgagtagggcgaggagacttgatcatagattccaacatctgggttgcagtcacaacaggcttgccttgaatattgcacttgaaaatcatcaccttctgtgcaaagaaaatcttctctataggaatttccatccctaaatcacctcttgccaccataaaagcatcagagtttgccaggatatcatcaaagttagctactccctcttgattctcaacctgcatgttcaaaactattataaccttgaatttgaaaatctactagtttgaaacccaaaagaaaatgctagaaccatacctttgacatcagcattatggacttggcatgctcaccaagtaccttcctaacctccacaagatccgaac

SEQ ID NO: 132 - DNA, 566 bp, Zea mays
gcagtttcaaatgcctacattttttttgtaattaccaacttaggttaaaaataactaaagataggtattgagggtgagggtgagtgagcgaggaagaggggcagctcaccagcggaaaatcgtagcaatatgttgttctgttgttcctagcagagcagcgctttagatcaatcacactcaaaggttgataaggattattcagtgcaacaccatgcattggaccagctgacgaagtagctgaatggtatagtaacttctgcgattctgtatcttccacttctcggtagatctaaatccattagaaatactatgtgcttcagaacataatgacatggatggcagttcggatttcggaatataagaactgcatgttgcttaaatcttcatgtgtgttatatacaaaatacaaaaacagtaaggacaacttacatcaatggtgcaggtgtgactagtgacatttgtagttacgactctccaggtaccacttgcaggtccatcacagtccaacttgagtttcacctcccactggcatacagaaagatgatgcatccttgcaccaacaagtt

SEQ ID NO: 133 - DNA, 752 bp, Zea mays
gcagtttcaaatgcctacattttttttgtaattaccaacttaggttaaaaataactaaagataggtattgagggtgagggtgagtgagcgaggaagaggggcagctcaccagcggaaaatcgtagcaatatgttgttctgttgttcctagcagagcagcgctttagatcaatcacactcaaaggttgataaggattattcagtgcaacaccatgcattggaccagctgacgaagtagctgaatggtatagtaacttctgcgattctgtatcttccacttctcggtagatctaaatccattagaaatactatgtgcttcagaacataatgacatggatggcagttcggatttcggaatataagaactgcatgttgcttaaatcttcatgtgtgttatatacaaaatacaaaaacagtaaggacaacttacatcaatggtgcaggtgtgactagtgacatttgtagttacgactctccaggtaccacttgcaggtccatcacagtccaacttgagtttcacctcccactggcatacagaaagatgatgcatccttgcaccaacaagttcatgtatcttcaaagccattgatcttaaaagtgaacaagcagtagcttcatcttggccaacgtcaacaattgtactcctgagtaacacgaaatgcttattaagagaccaatataatagtcaacgcataaacatattctgaaaaggattatgtgcacacttaccctgaaaatgggacgagatcaaga

SEQ ID NO: 134 - DNA, 734 bp, Zea mays
aacaataacaaagagatgatgtaagtactccattacagatgaccgaaatgaggcaatatctgaattgaaatatttaagtctatatgtggtagctaaaaatagcaggaaagctcacctctgaaccatttaggttcatcccaccttgaagttctgtttgtattgattggtagcatgacatatcagcaccaaggtaatctgaaattgcaaggctataaccatctgggataccatgtagagcatcgttgtttgccggagggttcatcgagccctccatgctagaatataccatctcacctctgattgacagcagattgtattagtacacaaaaatgaatcagatttaacatatgtggccagatgccacaggggataaagaagcatgtccagtaaatattgtacccacagttaactaatgcatagattaacaagggcagatatggctgctccatattaccagtgcaccatgcagaaataactggcatggaccaataataattagattagattgaaagacactgatccatcctcaacactgctatgacagtttctaaaatcaaaatgcatgctagccagaaatctgtaacaaatctggtcaatgttcttaaggatataatttgattgccactacagcccaaagcccggaattaattcatgttccatacttccaattccagtagtagctatgaacaggtttcatgttttccttgaatgaaaataaatgtgaaaatgaatac

SEQ ID NO: 135 - DNA, 847 bp, Zea mays
ttcttgcatgcctgcagtggcgcatgcatgcgcagaagagcagccgctacaaccaatccagacgatgtcgtcgggatctagtcatctttttcttctcagtaatgcatggcgattattacgccactgttcacacctgcacacatgatcggatcgtccgaggctttctgggttcctacgtcagttggtagtatttggctagctagctagctagctagcttgtgtttgaggaaacgtaggacgtcgtcctagctaataacatctcactttctgtttcgctccctcctttctccccatatgattgatctttacctactgctgcacacacacgccttttgcttccatgcctgttctcagcagccaccgtctctgggctaggctcttgctgtttgtttaaggaatagacatggcatgtcaagtgagctgacagccttgttggccggactggactttgtgaggcagatgccctcctaacccaaacctccccagtctccactgcaactgcaactagctaggcctgagcaggtcgatgtggacagagcgagcgcgcgcgcgacagcaaaccgacgagaaagaggcgatgggtggggcttggcttgcttgtgatagggggaggattctgcctttgcgggttcctacttgtggtctggcattgcattgcattgcatgcctcctgatgccaacccttcgtgttttgggttgtgttaattcctgtcaacacctgcatgattgcgctgcggcgtacgtgtggaccatacggtgctgcttctttggcttgtaagaggtgaaggggacctgttgcttgggcaggcctagctaaccctgtccccatttcgagatcaagcgtaaa

SEQ ID NO: 136 - DNA, 710 bp, Zea mays
aaaagctataagatggaagaagtctctcgtcagcattttgtccattgcttccttggccattgttggagtaatttttacttccaggtgataagtgtgaaactggtgtaggtgctgaaacatcaagcctgtttccatcaagtctgaccacaattgcatgtgaacatgacccacagcgcagcttgtactcatcttttcccagcatgagagaattcttgggaagatgcagtacttcatagcaattgtagcatatggtaaaaggggcaccattggcaattggttcacaagtctgtgcaggttttttactcagggtgtccctcagatgattgtgtcgcatcagaccattaatacctcttggattgtagttctgtgcaccaaacaccaccgggccttctacagggttgttcataagatatggtgccctgcgatggttgaaacccagtggagccccatgaacaggtaataattcacgatggtaacaatgtaagcaagagcaagcaggctgatggtagaagccgtcatggtgataagagatcagagggtcaggatcatactgtccatggaaatagttatcaaagtttctccatggataaggggcggctgggtaaataggagctcccatatgtgcaacagattgtccgtatccatggagatcttgctgtacagatactgaaggataagcaggaggaacaacaggtgcctgtccattcaaa

SEQ ID NO: 137 - DNA, 752 bp, Zea mays
tgcatgcctgcagacacaccttttagtacttgaaataacatgttattgacatgaatgaagaaggcccctttacccaacaaaagactgtttggggaatttaccaagtttctgagaagatctgctgcatcatctgataactgtaaaaaatgtgcaaattattagcaacacatggtatttgtcacgatgcaatcataagttgttaaaatacaagtgaaaaaagaaaataaaaactgcaaatcatctccagtgagagttcatttacaaaattagcacatcaatgggaaaaagtctgggaaatacttgtccatggtttgaagactataataggtgtttcgtttttaaaggtaaagaagggacacaaaaaaacaaaattctgttcggaacttcagcttggtgcctccccttctacttcaacaatagtttgttcattaaattccgcccgttttggggacaccaaaactcggcaactccactgcacccattgagaaacctattttccactttgcatggtggccgctattttgattgagcaattgaagccattgtcttcccctactgccaaatgctgttagtttaagcattttaaaacagatgggaaaatattagaatttttcgattgatggtttggatataaagataaaagtgaatagagcttgaagtaaattttcattagtacaaatgacagagttctttgtagtataattaactacctattacagtcactttcgtttacacagttctctatctattgc

SEQ ID NO: 138 - DNA, 809 bp, Zea mays
gatcctctttagtcgacctgcagcctcttttggtggtatggctatgcaaactgagatgagggtacaatagggcatatgaaacttaattcctaagtaacaatgatgctaggataagattaaaaacttgttaggagtttagtttgttgcaagttgatctctttagtcctttccatgttattttatatggagatggaatgggaatattgtcatgactcgtgaatgtagcaccccctgagctttttgttttattgcactttctagttatctaggtcaacttttagtgaagatttttcatagaggtggatgtgggaatgtagaaagcatcagttctgagcattctagaataatatttatggcatcgtctttcttattagaaatctagatattgtaacagtcgttgacatataattgttaaataatgatacaaaccatttccacttgacgcgtccatccccctgatttatcattattattcagtattgtgttaaccatccacattttctgtattgtcacatttattgaggaagtagtaaagacaataggaaaaggcaaaatgacgagagatgagtgaatcaatcaaaatggctgttcatatttaaagtctgtgtttcactaaagctcgctcctattttgcaggcctatttctgatgcagttaatcagaatgatctaatgggtattccaaaggtacctagtggagtttctggtactgctttagctgcttctattcttcgtgatggttggagtgtatgtactacatctttcctactctttttttctttggtttcacctctctttatgttgcttggaa

SEQ ID NO: 139 - DNA, 807 bp, Zea mays
atgatactgaatgcgacctcggacccggtgatcttagatcgactgcagtcacccgccccacgtcgtggtggagggcctcgtcccggggacgcagagctaccgcagcgtggcgcagtaccgcgaggccgtccgcgtgccgggcttcctcgtcgtcggcgtcgagtccgccgtctacttcgccaactccatgtacctggtggagcgggtcatgcgctacctccgcgacgaggaggagcgcgcgctcaagtccaaccacccctccatccgatgcgtcgtcctcgacatgggcggtgagctgcctgcctgcttcttgcgccatgggccatgccatcgatcaagtagaaaccttttagctgatcgatcttgttggtttctctcccgcagccgtcgcggcgatcgacacgagcggtctagacgcgctgtccgagctcaagaaagtcctggacaaaagaaacatcgaggtacagctgccgccgctggccgtggtgttgctgcaactcctgttcattcgtaacatgcatgcatgagctttggtgaattttaatttgcagctggtgcttgccaacccggtggggtcggtggcggagaggatgttcaactcggcggtgggcgagagcttcgggtcgggccgcctcttcttcagcgtagcggaggccgtcgcggagggggcgtgcaaagcggcgcagccctgacgacgacgacaggctgatccctgaggtgccgcacgggagcatgcataggaataggatgggtcagagacagactaccggtgctgctagtggtagtacggccagacgacgtacgaat

SEQ ID NO: 140 - DNA, 816 bp, Zea mays
caaatataagcttttgacttgttagctacaaagtctaaagggatgacactaaaatatatactcaacttaccagcgagatgtttcatagggattccagcaaatgcaagagcagcacaagaagcattaattgcacatggcataagctaagcactgtcaaggaaacaaggactagcttcgattgaaaaaagaagctactcatattttgagttaaaaggtcttggagtacgcatgatgttttggcaacaaactacatttcaaggaagagccaaagatatccgacaaagattcaactctctctaattccaagcctagttgatgtgaccgattcgctcatgccttcatgcattattccctataagttaccacctaattgatcctagcaaatttatccaaaaaaccattagctaacagtcagtagactaaaatttgaagctttaatattgaatgcaggacaacaaacgcaataaacataaaagcagtcaaactatattactgctacatcatgtggaaagatacagaaccatcatcacccacaacctgcaatagcaagattaacaatggataagtgacatttagtggtatgagcacggacaacggtagccaacataagagaatgtacaatgggtgtgcttagagatgatgattagccaaaaaaaccttttggaagtggggatcctatcctagtaattattgtacctcccatcagtactataagttgttcattagttcacataagcacatcaagtctgcacccctggagatgcactgagaaagctagttattaaggttaaaataagggaactgagaagtgcattt

SEQ ID NO: 141 - DNA, 777 bp, Zea mays
cagcctcagcagttttaagtttctctatagttcacacttcacactacaaatccggctgtgcccaaacaactctattcaacagagaagcatcgaaactagcatggagcaaaatctgaattccttaaatctccaacctaaaacacttagccgaccaaaaagcccctgcttcccaaacgattcgccaagttcgttaaagattttgggggaaaacgaggcctaaacaacgggaagtaagggaaatcaatagaaaaaacatggttttggtgagaacctgtgcctagccgcgctctggggaagattggctgagggagctgcgttttgggggagtgcaagaggagcacggtatccagggaagatgtgcgggagagagatatatattggatacagctcaagaggggaggaacgctcctccttaattgttcaaggcaacgctcctgccttcttccaaaaaaaagaggggaggatcctgacaaaattccagcaaagataggtgtgagagtttattgctgccttccttttctgcttgccttttttatctcctcaaaagagttgtgtttgtgttctatcccccgtaaaacacaatttggaaagtgtttctcaaaaattctgatgcatgcattgactctcttttttttgtcactatcctggatttctgtgtattcttatttccattgtattgataactaaaaaaatgaagccatagtttgcccaggtatatgtttgtgttgcaactctgtaggaagaagtaaaaaattgatgatattgataatactttat

SEQ ID NO: 142 - DNA, 809 bp, Zea mays
tcgacctgcagttggatttccttctgtagcttccagtcctagtgactccatgcaccgaatacaacagcctgctgttgcttcctcaaagaggaaaacaaattctgtccccaaaactcaaccgcctgtgagtgctgttgggtctccagccagtgtttcaaacatgcatgcgctgctgaatgcaagcagtccatcgattgggaccacacctatgggagaccaagcaatccttgataaatttgtgaaaattgataacatttcccatcggtatagcataatttctacatctgctccctcccttcacgaatttttgttgtcactttcctttctattcttagtttctttggaagtctgtcatgggagactttttaaggaagttttgggttgcacggtgtgaatttgatgtctaggctattttaaagctgagattcagccctattactttggatggtcacacaaaaaaatgtcaggctataatgtgcaaatgaactgtttcaattctttatcaaagttaatcaacattttaacctaaataactagtccctccagttcaaattgtaagttgttttggtttttttagatacctggttttcactgtgtatatagacatagcacacatctaggtgcatagcagaacctatgtacctagaaaagtcaaaacaacttacaatttgaaattgagggaatgcctaacaaaataaaagggtgaagagttaaaacatcttttttaggaccggagtttctaaaaaaaaccctggttggggagggaaagaccaccctcccggtattaatgcttggagttgacactcaag

SEQ ID NO: 143 - DNA, 810 bp, Zea mays
actgcccccccctccttttatagttatacaatatgtacatcatgtctatgaagaacatccctttgaaatcctttgcttacatactaaaacaaagtactgatcaaactagatacacttaaggcaaaataaatcagctgcattactgttgtatcattactatgataacatttgtcagctgagtaaacaaaaggcattgttaaaaaaacatttgcaatcaatgtgtcctagagccagaaattaaagctaaacttcccaacggagctcacttaggagggctcaattgatatattatgcaaataaaaaaaactcagccagggaaggaatgaccgccatcccggtattatatcaagatacactaaaacaatggtctcggccgagaaaatccccaaactctgccccccccctccccatcactaacgagccgacgtcaaccgtcccctctacagcggtccaaccggagggtggcgcacaggaagccggaaaattcgcccctgaggggaatcgaacccgagacttggaggtgctatactgctattcggaagcctttaaccactaggctagaggccatttcgcatatattatgcaaataacaaataagattgaatgcacgagtatctaacctctgaagtgatgtgaccatgtgatggcttcagttcaacatctttctctgaagtagcttttctgcgcgcagcatttcctagtatgtgggcctttaggttcatccaaactcaatttaagaacagcttttccttttccctttgaggggtttatgcttccctcctgataatccttcttaattgcaccactggg

SEQ ID NO: 144 - DNA, 782 bp, Zea mays
atccatccggatcttgcattgagttgaccatcatcactgccccaggcgtggcgtgccgcacgctccctatgcaaagtgtacgaaatattttatacgcgcatcaaccattccacccatccaaggaggaataaacaagccacttgtctgctaatacaggtgatgaagtgggggaggaactgctgtgtattacaaaagtattattgcctttgtagttcgtgcagataactacttgaaaaactggacaaactgtgctgaaaaggctagtggaattcttaagaatatacagggacaacagtgagctttcgcattcgacctttcagtcacgtacaggttccatttcagcacagcacagcactggaaaggaggtcgaactttttttacctttcagaataacaaacaaatcctagtactagtaccagaaaatgtctacgcttgtttatttggcaggcagctaccagtctgtctatgaggggggtgcgttatggtatctgtactatatagtatacagtctggcaaaagtggcaaagaaagaagacaggcgagaaatcagaatttatgttgtgtgttagggaccaatgccgttcatgaagggagccccccccccccccccccaagccacagccatttatgatggccattcatttccaactacctttaccagcaaacactttcatcatgcattttggaatctttggttccagcaggcaggctcatcataaatgggttttagtaattttgtatccagggtcttttatctccagggttttatagtacaggtttga

SEQ ID NO: 145 - DNA, 971 bp, Zea mays
aataatactcagcatggttgcggggacagtgccgataccatttgggagaggtcagtcgacttctctttatgccgatgtggtgatgttgattgtattgaggtctgtgatatcagggagtggttgccaaaatcaaaaatggaccataagctgtggaagcttgttcttttgctaggagaatcttatttggcacttggagaggcatacaagaatgatgggcagcttcagcgcacccttaaagttgttgaattagcttgtttggtatatgggtctatgcctggacatattgatggcgacgagttcatctcatccatgtccaacagttcattgagtcgagaagatcttgccctaaaaactaaacttgtactggacgaggcagactattgcaataacaaaagatgcttcagttatgaagtttcttcccaccaattgccaccaaattatttgttctgggcaaaggcatggatgcttgttggtgacgtctatgcagaatatcacagattgaatagtcatcaagcaaagttggcaccagaacagaagtctcatggcgaagttagaatgtcaaatgaagttgcattggaggtcaaacgccttaagagaaaactgggaaaggataagcagaattgtgacacatgctctttgataaactgtagctgccaaagtgacaaggcaagtagtggcagcagtgcaagcagcaatagttctgaagccctctaaactttacagccgaaagaaaaacaaaaaatcacttggtaagaaaccttaactttaatcacaatatagagaaaccagccaggaccccaatgcacaagaagcttcacaagggtctgaaataaccagcatgatgtgaatgatacttgttttgagacaactcatattaaatgatgatttgggcattcagtcaggccaggaaaattaacaagaaaggtgatggtgtcctgaaaatttaaacaaaggttcctactggagggatg

SEQ ID NO: 146 - DNA, 677 bp, Zea mays
atgaggaatcattaactggaggatcatttgatgaaggaaatatggtcaagaacattgaagcctgtgactggttaaccagtgctataaagaacctagaagcgtccaacatagacccaatctatgtaaagttgcgtgctgtaggttccctctcttcgtacaaatagcatttgttttcgtattgaaggtttacatacctgagatttttgttaatattacaaatcagtggaccttaacttagatacacagttagatgcatagtttttcgggatgcatagtttttactatgcacttagatatacactatatctagatacacaacaaaagcaatgtatatagaaaaccaaaatgtcttataatttgaaatggcatgagtatctattagtatgctgctctggtagaacttgaaggatttttttatgacatggaaaggtggatatattgagtagaaaaaagaagaaatttccccataacaacaataaagacttttagttccaagcaagttaggttaggctggagttgaaatccaacataaacgacaaatcaaggtttaggtatatggacaactgttttttatgtattcctattcaaggctaaatctttcggtatattccattctttcaagtctccttttactgtcttttctatatcaatttcgatcttctcctgtctctcttctc

SEQ ID NO: 147 - DNA, 783 bp, Zea mays
cccgggcccctttaaatttaacctgcagctgaaaaaattgacagagcatcatcatctgaggtcagcaaccctgatactagtacatcagaaacaggttctccattctatcagcttagaacagatgctacaaaacttgttgcacaaacatttcaaagagggcgaagaaatctttggcagctggcaacaagtcgcttatctgttctattatctagttcggctgtttgttcaactagcacataccaatttctgaagaattatgaagatcttgccattttcattttggctggcgaagcattttgtggatttgaagctagtgagttccgccagaagttgaagactgtctgtttgaactacatggtgtcctttcaccggcaaaatgtatatgtatgtcaatagctctgactcggttcttaatgatcagtgctcaaagttcaaacatgtgaattttgaactgctatcatctttttaactgcttaaaatgtgtatgcagttcatgacgtgtttgtagtctttacgaacattcttcatatttcttttcttttcttcattggtagtgctggtttcacagtagcccatttttgtaactgattttgatataagctaccagtgcttttatgtttctacaaaaggagtttgcagctgatatgaacattagtcagtgcagccacattagaaggctttgcattgatatgcaccataattccataagtcactaacattcacaatataatctgtaagagaatacattaataataatggttgattgtacgtccctatcaaaaa

SEQ ID NO: 148 - DNA, 779 bp, Zea mays
  misc_feature (776)..(776): n is a, c, g, or t
tggcttgttctggcaatttcaatctcatcttgaatgaggaagataagaataatcccaatctagaccgtgccatgatggggaggttaagaaaatgggctgatgatatggttcttaaggaggttcctctcgttggtcgcaaattcacttggtcgaatggtccggacaaccctacccttgtgaagttggacagggttttctgctctgcctcttgggaggaccgtttccctgattgtttgttacagagttctgcttccagcgactccgaccactgtccactgttgtttgggcttcatgactttaatagaggaaaggggagatttcactttaaggccttttggaccaagatggagggtttccatgaggtggtgtctcaggcctgggaatctgtcccagctggccgatgtcctctcatcaccttttcaaaaaaattgacaacaacatcgagatgtttgcagagctggaatgagaagaaaattggggatgttagaattcagcttgaaatggcaagatatcttttacaccatttggagttggctcaagatattcgtgttttatcccctgctgaagtttggctcaggaattctctcaagaaacattctctagccttatcttctctttcaaggactatggcactgttgagatcaagaattgcgtggctaaaagatgcgagatgctaatacctccttatttcatgccccaagcaagatttagaaagagaaaaaaaaattatatcagctttcattgatggggagggatgccttctgactgctcatgangat

SEQ ID NO: 149 - DNA, 805 bp, Zea mays
tgtatcatggacacattttcattggtgtgcttatctcttatgcagtgccattgttatgtctgtgattgtcctgctccctgtgccctatgggacaagcattgtcatgctacggacaaggatagaaagtggaagagacttagggaaatatccaaaaataaaagccagccaaatcctaaacgaagaataccccagcatttcaaacgctcagtcacaacaggaccatcatcctcacagtattccgcaaatatgactggttttactggaagatttcctgcttcgggtactgcgaaccaaattcaacaggtggatatctctgttatggttgcacaggatatggtgaggggtatcagtctgccgagtgcaccatctcctacgccaagaactaaaaatcggagctatggatccaaaggtgcccagattgctcctccaatttatacattctcaaatgataatcatttccagccttctgttcctagctatggtctggtgcggcctcatgcatctaaaactgcacatgtttcatcaggaggtcatgttagcgctaagacttttcagagtaacccatctcagttttgtgttcgtgcaccaatgggatctcatggacacaggtaccgaccaccatcatatcctcagcctcctcctaacacagttgttggcactggtgtgcccctctcacggtgcgcctcgctgaacgctgagggctcagggaacacaacgcccacaagttccgccggcaggtacaatatcgaaggaatcacttgcaaatttggcacgtcggctgggattaccttattacaatactaat

SEQ ID NO: 150 - DNA, 978 bp, Zea mays
ttctctataggtttctagactattatagtaaatttgattgggataataaggggatcagcttatttggacctgtttccttatcttcactacctgagctagttagtaagtgaatgcactcttaagtgttcatgttgtttatttgcaattgcaattactggtcattgacatgcttttgttgaacagctgacccaccagatatccaagatgatgattttcttcaacgggaggaatttctaaaagaatgcatagaatcttttagtgttctccctagaaactctgagacgaatcctagactattctcacggagatttttaaatattgttgatccactaaagcagagtaataatcttggacgcagtgtcagtaaaggtttgtttcctgcctctggatcatcaattataataataaaaatgaatcgtgtgttcatgaattttctcgtcaattaaacatgtcaataagattgttaacttgatgcactgaccttaaagttttgtatgagcccatttgcataaggacttacagtgccagtcagagaaaaaaaatcctgcttcagttgtttttgtcaagtttgaatatttattccacagactgctcagctaatcttttgaacactctgtgcaaaatttacaaaatgttttatttgatgatttgtgggttgatgatcctgtctcattgaatctttatcatcatactatcttttcacctaatgtgagattgaagtggactgctttcatcctgatctgtactgttaaatactctgtccaaaattctaaatctaccattcttgctaatgctacctaatgttatactgactgccttgcttctacattgctgatgcacagttgcacacccaagagttaccatttcagttgtgcgtagaagaaactgttgccatttagcaatattagtatgtctacactcactcaccactaccagcacccattgtgctgcgcctaagcacaaatcttcaataccttc

SEQ ID NO: 151 - DNA, 802 bp, Zea mays
tcaagtactactgatactgatcatagcgaaaactcacggtcacacccagctcttagaaatataaaaaaacagctagtgttattaacttattatcgggtcaaaagaaaacaatcgttaacacataaacagatccatggactattgtagctgcaatcgggtcaaaacagaacaaacaaacgggtctgatatcaactgggttacaaaacgcggtgacgcctgacgcgtctaacttgtcagccacgagagcaaaacattaattcacagaataacagagcagaaactaaaataaatatgattggttgaatttaaacccaacgattgcaaaatgtgacttattggttaatctaaatatcaaacacttgcttgtcaaggagacagacccagtggttgtaggactttcgattggaaagtcttttttctcgaataagatatgcaagaagccatacgtgtgagtacatttcatttctctagaaaaacataattgcctatttcctgcacatataaaaaacctagcgcagggaaagagggaatgaatcacacgaaagaatgggaagagaaaagaaaaacacctacttacatctctataatacatctacagcataagcactccaaaaccacatggattggaaccatcatctgtacacaaacttatcagactgcacgatcctaagaagttctcgtaggttaccaaacacgtgcctttcacagctctcagcttcaacatagttcagaagctgcttcgtatcctaatcatccacgtgaaaaaataaaagtaaaacctcaatatttgcaaatttaagac

SEQ ID NO: 152 - DNA, 726 bp, Zea mays
atgcctgcagtgcctcaacgatggcgtgccgtctagctgcccctgccaccgcagtgccgtcctcgtcgtcttccgggcacttcttgcagatgcgcagcaacgctgacacgacgagcgcggtggccgcgtcggacacgcagaacattttcttgaccagcacgggcatgacgagtgcgtcggcacgagcacgcgctctgccgtcgcgagacgccagtgctgcatcgagcgcggcgagagccttctcggccgtgctcctgtcagcgtccacgaggagctcgacgagcacgatcacgatccccgccaccgagaggcgcgtcgcggcgctctcgccgctgcgcgcgaggtggtacgcggcgaccaggcacgcccttgtggccggcgggcagatggcgtctctgatcgtcttcaccaacactcgggcgatggcctcggtgttggcgcacagaccgatcgtacacgcggtacctctgtaaactgaaagcgagatgatctctctgattaccaccacggcttgcagcctcctgtgcaggtcgccgttcgcggcgacggcgaccagccgcgctacggacgcgctcgacgagcccacgaccaggatggcctcttcgtccattggcatcacgagcaccagcgctgccagcacagcgtcgagcacatcaatggcgaccgcagcatctgcggtgtccgcaaacgacgtgaacgccatggagagagcgcgcgcagcgcccg

SEQ ID NO: 153 - DNA, 740 bp, Zea mays
agctcggacggaggaagctccagtcgacagcaaagactactggggcgcgcactcacttccacggccactgggtctcggactcaccgtgaagccacggcaatctgatggacatggactaggttaacatctcctgagcctgaaacgtgacagctgacatgggtcagagtgaaaagaaaattagtttaggcattaggggacacgacgcagaacggggtggctcgaggccaagcgggcggcggacccgagcggataaggacgagctcggccctcaactgtcgctgctgtggcgcatgacacaaacacaaagcatggtttcctgttggtaatttaccaccactagcgctagcctacaactggtatgttttttgtttttgtttttttttgcattggatcgtagaattataaactttataatatgccataaaagctgaaggttgcagtattagtttaaattattctatttgttaatttaaaacgttgtcgcaggctcgcagctgctgttgctgtctgctttcccctcccccggtctacaaagacctcggctttcctttcctacatgctcttcttccttccaaagccttcgcatttttcctctcgtcttccccttccccttactccaaattaccccctgctatctacatatcctgtccacactttccttccctgcgctgggccttggagttttttggttgtgtatcgggggaaatgggaaatcgacgacgaaattgccgatcaatagt

SEQ ID NO: 154 - DNA, 748 bp, Zea mays
atcatttttcaaccaagtaatggagatcgctttttatttttagtatgtcgcatcgttggctagagctttgatctaccttcatggcaagcatgttatccatcgggacattaaaccagagaatcttttagttggagttcaggtacttgcattgtgttcttttttggtatccctctggcaccgggtctgctctgcctcatctggaagactggaactatatgcttgctttacatcgtcgtctgtttccttggaacagggcgagatcaaaattgccgactttggctggtctgtgcacaccttcaacagaagacggactatgtgcggaactctggattacctgccacctgaaatgggtactttgctagccatttacctccagttatgaactagttcaatgggttttgagaattcccacagcagtacctagctgctttccttggctctgaaacctgttgtggtttatccagtggagaaggcagaacatgattaccatgttgatatatggagccttggtgttctgtgctatgagttcctttacggggtcccacctttcgaagctaaggagcactcagaaacctacagaaggtaactccacaactctgggatcttagtatgtcgtccctaacttgccgatatcttgccctagattatttcctgtggcttttgacttttgagctatgctctgataactgtgaggaaacttttgaagttgcatatagtgctagtgtagcaaagagagagcactatattg

SEQ ID NO: 155 - DNA, 853 bp, Zea mays
tcggctcccggttttcctctagagccgacctgcagcggatgcgaagggatcggccgcagcagcagctgccgtcggttggtcggggaaccggaactcgctgccaaacccgcgggactgctggagtgtctgggcgaaggcctggtacttgcggatgtcggcgtcactcacgctgcgacgggcgtacttcatggactcctcgaagtgagcagccttgatctcagcgatgtcgtctacctcgtcttcctccatagcctcggggttgtctttgctgcgcctctccctctcgatatcctgaaatcaaatgtcccggttagcaaacaggtatactactctacgaaaccaaatgctgcaaaaaaccgattatgggccaagagattactacaccttctcgatgttctccctgatggcatacttgcacgcgcgctggcagatctctgtgatatctgcaccgctgaaaccctgggtgtatttggcgagagcattcaagtcaacatccttggccacaggagacttcctgagacaggctttgaagatctgaagcctggactgctcatcgggcagaggaatatagataagctgatcaagacgcccaggcctcagcaaggctgggtcaatgatgtccggtctgttagttgcaccgataataaaaaccgtcttcttggcattcatgccatccatctcagtaagcagctgggtcaacaccctatcagcagcaccaccggcgtcaccaacactgcttcctctctgaaaatcgcaatagctgtcagttacaactcatttgcaggttgtgtcagtgcgtgagcacaatgcataatcgagagaccatacctgagtagccatggagtcgagctca

SEQ ID NO: 156 - DNA, 730 bp, Zea mays
tgctcgacatgatcccaccagcccatgaggaagttgtccaccaccagcctgaaccaaggggacatcttaacgccatcttccccagcatcagctttcctgagcagctccttcagctgatcgcggttcacgtacttgacgtcggccacctcttcaggattcgggttgagcttcacgtcacgaaccatgaacaggaggtaatccactgaaacaacagaataggaaaggttgtaaagcctgcaactgcaagacagacccttgaaacatgtagagtacagcaaacacaaatagtatgaaaactgggaatccaggatgtgatggcaaaaaggtaatcaagtatgtacactcgtgttcgccccattttccatctgaaggagccatgtaaagcatcctcccaaggaggatgaactggtcaacaggtaattcgtcagcaactattcccagttcatcaaatagtttgcgttgggctgcatttctcacccctgaacagaataaatgattgtggctggtgatgagtagagtgcaagtaacaatatggatggtgcatacaaatctataaagtatggattggtttctcactctccaaggaacatgtatatacctgcacaattttcctcaatcaactctgactcgcggtagagaggatggctacagcaggtgtttgtccagacaagtggaaatgtcacttttgtgcagacctttgctgtaaggatatgaggtaccatatcttctt

SEQ ID NO: 157 - DNA, 1019 bp, Zea mays
tacacattcgatatgtcactagaaatctacaggcaaaccccaaaattacacctttcacttttacagccacaagacaaggtcaggtcacgtatgcagctatgtacagtcaccaggtgatcggcaaaatcctcgtgtcctaagaggatttcatcttgtccaggttgtgcttagcctgcaaatcatataaagattgcatgagcaagagattcttatctttaatcgcagcttcaactaatctcagcaaacagagatgtggagttcgaagccctgaccgaaatcgcatcgatctcctgtaacaagggctggacggcataggccagcatcctggcatcttctgctagatcctccaagtcttgacagttacccatcagcagcgctacgaagaactctctttccgggatgagcttcagtgctacctgacaactatgctcgacagattaggtcagtgagcaaaaaccaaacctactagtaattagtagcacacttagctcagcaagcatgaccacaaatttaaacaacaaagaagtgtatctgcaaaccagaaagtaatagatgtgactgtactagctgaggaatgcggaataagtatccaggtgatataccttgtaagcagctgacgagatccagccatgccatggcttcagagtatttgcgtaggcttcttccacgatctcttccaggctcgactcagcaatcttcaacaggctctccagtaagtactttgagaaatttatcgacctagacagccagattaatactttggggcaacctttgggcttttcgctgggcctggtcattttctcggggaaattaccggaaagcaccgtttttgaaaaaacctttttgtcgggttggaacccttggggaagggaaattaaggcatttggttgtgttttccccaaccaaaaattggtgccctgacacggttaccctggggaaactttcaaaaaaaaaaaaccctctcttccaagaggggggcccccttttttatgccccccaaaaaaaaaagggcgatcttt

SEQ ID NO: 158 - DNA, 805 bp, Zea mays
caactgtggcacagccggtctggaaggagaccgcagcaatagtcgatttgagggcatatagcagtgaagaaaaagcaggagggagaagttttgggtggtggccatgcatctggataatgggagaagcaaggtgcgccaagggagagagcattcacacaagagacagaggacgagcagtggcgctgggaatctgggtccccattaaatgtatccatgtaggttacccaggggagggtacatgggctggctgatgggctgggccagctccttcttactcctcccttctccttttttcttttttccctttttcctcagccacatgttagaatttgtatggcactatggtgtagcctttcctcgccttatcaccgcctaggcatcacatagacatttgctaagtgtttggttcgccgaaatgtaatgtaaatggattacacgaggtaatggataccgatacttatgtttggttgagttctttctagtaatactaggtactaatatccaatccaattataactagtgaccattaccgccggtaagggatcccattaccattcccttaacaatatatgaaccaaacatcaccttggaagaagctggctcgctacaactcagccatagcaccttaagaaccatgattaaaattcctctaaagtaaaacacattactccatagaaaaactagaaaagatgaatttatataaggttttaaaaagaagagagaacaaagaccacaacccaacagctgcattctgaaactttccattacaaattgtattagatgtatagaaaaatgaggagacaaa

SEQ ID NO: 159 - DNA, 1277 bp, Zea mays
  misc_feature (151)..(151): n is a, c, g, or t
cttgcatgcctgcagttatggtgaccttttaggtggtcatcttgttttgttgtggccggatggccatgattattaatttttcttcttctttctttctttctttcttttcttttttgtgtttgtatttggtctatttttagaccctccttcnttcttaattcaatgatacgcagctctcctgcgtgttcgagaaaaaaaattgtagaatgctagataggctgattttgttgtatattttctagagctagagaaacacaaaaagtgctgatcatcttggtcagatagagtcacttcatgtaggatatcccaaagttgaaaaaattgaaaaaggccaaccattgacaaacatttcatgtaggatatcccaaaaaaagggcgtacccaatgccgtaggcttcccgcactgtgcggggtctagggaagggtatctttaagcgccaagccttatccgcataatatgcagaggctgtgcttgaacctgagaccttccggttacagacggtaggctctaccgctgcaccatgcccacccttctcatgttggatatcccaaagttgaaaaaattgaaaaaggccaaccattgacaaattaccctgggtatcagaaaaccatctctagtcccctaaagcatcaaccacaaatatttttctcttgaatgtaatttaaaccgcctcgaacgtagctggagcaacatcagctatgctacgacccatcagctatctgacggaccagaaaagggtcgtcaaatcattaccaaccatagtaacgattgcaatggaaaaaggatgttgctttcttgtgaactagtatctctaagccattccaagttctcggtgccccagttttttctaaccagagccaacggacttgcagagcccaactcatgagcacaaatttagacaccttatcccaaaccacaagacatgaaccaccattaatttgttgtctacctttccataagaaagctcttcttgatttatcgattgctttgatgaaccattttgggaccttgataactagcagcacatgaataggaattgcagtcaagacaaatttgacccaagtagctcttccagccattttcataaggcctactttgcaggaagtttgttatctatcttctcgacccatgaccaaggagcgaattttgttaactttctgttggagatgggtaaccctaaataagtacatgagaactttgagcgcacacaacggatggtttgctcaaccacctccatatggtctgaaccgcgttaaaaaggaattacacaactttt

SEQ ID NO: 160 - DNA, 1296 bp, Zea mays
atagaggaacattatgattgacagtagatgccagaaagtcaagactaatggaaaataaaacaaatagtccagatatcccaataagtagaaagaaattgagtgagcagtaaataaaaacaaaaaacaaaattacacaaagcacaaggtacatgacaaaatatgggcacaaaagaagatgtcctatcaagatagaaataagaaccacatgtcacatttgaactaagcagttaaatgtttcgaaatagacagagtttgacaaaacttcaaaactgaataaaacacaataagttttcacatatatggtttatttgcatatgacatgagtacttgtgctttgcctaagacctacaaaattcagtacaaggcattagacagtgaataccagtgaccagccctttagtcccaagcaagttgaggtaggccagaaaaggaaaagatctccaaccctcattgtccagatagtggttgctcagttctagggagggaaaaagatcaaacaaacctgccttgaatgcatagctggtgctactgtcaatcaccaaaaataaaggtcttcttgtaaatgggattagatcaccagggtatatgcaatttgaacctatatatttcagatatggcagaaacaataatcttaatgaaaatgacataattctagtcagcaaaaggaatcttataacaaaaatggaaagacaataccttcagtttcacggcagcctaaccatagacaaggttctttgttttcctttgaactagtatgactaagactggatatgtcaaacttattaaagttgctcaaaacattttcaccagtatcaggacaaaatccagaagttcccatctcccctgcataatattttaatattaactgaaatgtcattgacatacacagaaatgtgacaacattaaagcaaacaaccctggggcactaacctgtagctgaaagatatattaacatgataccatttgaaggaagctcctcgcattttgtggaaaggacctggatttaaacaaacacattttagaaaaaataataataatattttatatggttaaatggacaaataataacagctgcatatagctcttaaaattttgaaactatgggtagagttgaactagtcttgctaaacaaataacaaacacagaccaacttaagttcgatgttaaagcatctgtgttgtcacactttctaagaaaatttgcagccactcatgccatgaacttaagtagcgtccctcatcatcatgcttccttgtcagataattcatatcactaagtccgtacgatatattgcag

SEQ ID NO: 161 - DNA, 1062 bp, Zea mays
agatagtggtgtaacccatgccgagcatccggaggagggcaagtgctccttagctgatgatggaaatatccagaagtctggggttatggtcaaagaaaaagagacacatggacaaaacgctggggctagtttggatttaactgaaagagttgagaatgttgacactggtgaaaaggcgagcggaggtaaaatcggtgatattggcactagtcaactgagcatgacactgtatgagaaaagtcaggctgctcacagggaggagaggccacgcaggtatgaaggcgtgcatgttgagtctcacaaagctctgatcgaagagttggagaggtctctttcgttcagcagtgaggatgactacttctcggacgaagcagaaagcagtggcctcagtgatgctctgcgtaaccaaatgggtagccgcaggtttatgctagggggcagagtgaatgatgcgccccgaagcgatccacatggtcgattgattgaagaactagagatgtctttcagcgatgcagaagagccattggagcagcatgctatgggttcagagagagttcatggaaatgtgcttgacaaggatccacagatcctgagtgataaaagtgcacatccatgtgaagaaagcctctcatcatttgagagtggacacctcaaatctgaacaaactcctcaccaggaaagcagggcaataggggcaataggcaatggcaatcaaggaaatgagcgtattgaagataacaataatactgccgactctgttcatgggagtgagcatattgtgattgacgatgacaaaattgcagatatattccacgagaaagaacatgataaggattgccagcttgcaaacatagaaagtgcatacccttctgaaggaagcacctctgctgtcgatgattgcagtattgaagttcagcaaagttttcaaccaaatgacctgacagcagtcgatgagtgcagtattgaagttcagcaaagttttcaaccaaatgacctgacagcagatgtcaatcaagaaatggaagatgataagataaccaatgataacatagtacctgcagg

SEQ ID NO: 162 - DNA, 533 bp, Zea mays
ttgcatcggctcgacctctcgaacaaccgcatcgccggcggggtctcgccggaattcaacaggctccagaggctcgctactctgtacctggagaacaacagcctgaatggcacgctgccgtccaaccttgacctcccgaagcttcagcttttcaacgtgtccagaaacaacctcaccggccctgttccaaagtcgctcgcccggatgcccgccagcgcctttgatgggacagggctctgtggtgaccctctagccccgtgcccaacccctccgccgccgccgccgccgcctgttccggccgctgctaatggtagcatcagcgcaaagctctctactggtgcgatcgccggcattgctgcgggtgctgccgtggcgttcttggttctgatcgccgtgatcttgttcctctgctttcggtgtcagaggacaatggccgaaaaatccgcggagacggcagccgacgccgacctggacgggtctcccgtgtcggtcaccgtggcgagcatggacatgaagaacgcgacgaggcggtc

SEQ ID NO: 163 - DNA, 1075 bp, Zea mays
aggttaaaacatccacttcccatgtcacaataatccccacatggagcaggaagactagcaacgtaacgctcaattttattatttcatagtacaacaaactgaattttagcaagcaccaccatattattcccctgcaaaattcctttttccttatgacgcgaaatcgacatgatttggccaaccatattaaaatagggtggtggcgaaggggatattctccaaagaggtcccgttttcggagagttggcagcatggtgtttggccagtttggtgaaattggagaaaaacaaaacttggttcgttgcttttacaggtcaacgggttgaacctggaaatggcgttgatgcaggtgacagtgtgtggttaaaaataagctttcgtcgggctcctgtagaaagttgtagtcgtaggttgcttcatctctcagaaacatatgcaggttagaaactcaggagctttccatgttgcagatacagaccccaggaatcaaggatcatctggacgtggatcaattgcagccagagctacgttctcttattttatctgtctagattatataatcgaacaaatttcgaactaactggacaaattataatctcagacaaacaatcccttagtattggtccgcagcataagtttctgctaattggtttctcttaacttttaaccattagcattacaatcttgtcagatggatggctctcttattatgtcgtgcttgcagaattcactatggtgtgtgttccaacgattcattaagtatcatacggggaaaaaaacaagattttagaatggttgtacaattgaaaatgggttcacctcaccaaagctggcaacaaccataacagaagagaccctacactacactacactacaatacaagcaaccgatccgcagcccgggcagctttcagggaaagagaagtcgagaagaccacatgttcctggagttgcagaagggacaaggaacttggaccaaaaggaaaagaaaaacgaaaagaaaggacaaaggaactgttctgaacagcaattcaaacttttgcatgttcagcatccataatttgctttctaccggc

SEQ ID NO: 164 - DNA, 1310 bp, Zea mays
cagtcttgcatgcctgcaggattaaatcactatggagcaaattaggctgtctccaacagtgccggtaaaatgtcctctaccctaaatatatcatacatatgtgtcttgtaaggctaactgcaacggtgcccccttggaacccctccccttgcatgccggctgtaggggacactctacggccgcagcggtgccccctacagcgcccccctacgcgtcggaccccttctctcccccccagatatagtgtgtcactattcatccctctaaacactgtgctgtgggtacacgagtaattgttagtagataaaaaattgatagttgatatagaaaatgatattttatagttgtagtggggtatagggggaatatttaggggaaccgctgcgggagatgaaaaaatagggggaaaaatagggggaaaaagtgatataggaaaaaaaaattagggataacggttgcggatagcctaagcgtccagcaacaaaccctaaatcatccgctataatatagcggctctctctctccctctattattggcggacacacgacgctcgctatgcactgttcaatcacgcacaccaactccttccattctctcttgcgcttgctcgtcgtcgtcgtcgaagtcgttggagctctcgacgatgctgagctcgacggcctcgccgccttccccgtccctgtccccacccatggagcagaagatgtcgaaccatcgccaagctacacgtccgagccatgggtagtacaacgcatgcggcgtggtcgagagggagtagacgagggacggcgggaggtcggcggctggggacgacgttggcaaggtggaccacatgatgcttgtcgccaatggctacaccgagctactagtgttcctcaactacctcagcgtggaaaacgcggacgcctggctggtgctcaaggaaatgtttgagcactatagtctatagacatgaacgatgtaatgcatttttttaaaagaagtcggataaccttttccttatagaaacacgagtagtaatgtaggatacaaaatgtaattattttaattagttcctaattcatttttgctagaaatgatttttattgcgaaatctggcacactgtagatatagaggactgaatttaggtaacattgctggagatgacgaaaatatagatgacagaatctttaagagtgtgttgtaaaggataaagaatattcttatagagggtgaatttttatagagggtgaattttagaggacgttgctgaagacagcattagagaacagtactgcagatgggtgggcgggggagagagaacttgat

SEQ ID NO: 165 - DNA, 1306 bp, Zea mays
ttaaaatgtgtagctaagtattagctgtggtaaatctagaagcgtcaaatgattaaagatgacaaaaaaaactccatgaactaaggcgtaatgcataaataagtagagatccaagtaaaaggtatatctgcaaagaccatgattatgcaatcagtaactcataatgattgggggaaacttgccaaaatcacaaatttttgccggcttccaagctgtattcctgggcaacacctctgacggatattaacaggatgaatgccaggtttcgcttttgttctgtctagtaaagcttcatggtgactctgactccttccatcttcttcgtcttcatcatttgtctgatgacacaggtcaaccctgtaacatcataattttgagaaatataaagctaattagctaaataaaaaaggcattcacaactcaagagaacccccaaaaaatgacaggtatgtaccaccaatccatcacagcaaagtttgaccattgagagaaaacaaggaaaacctaaaagggtctgaggctctgagcaatattacaagcatagagcctctgttttaaaggtgtcacctaggtgtccaagcgaatgtggcacaccttggatatctaattaagcctcgcctaagtgtcacctagatgataaggcgtacccagctcaccttgttgctttcaaaacctagcagcgtgatatctggaggcactaaaatataatagttacagttatattggcatgtgccaatgcacgacagagttatccaattatcagttatccactgatgctagtaaggatctagttcgagtttctttggggggagtctggctacatgccagccatatgaaagaactacatctacaagagagtgctcagtgtattaacacttcaaccacagtcgcaggaaatgcggtatgcagtgtggctccctgtcccggttccagatcagggttaggtacgaagccgatcgcaagctgggtcgatgcttgggacatcgtcccgaaggccgttggatcattgagaagcataagagcttcatcgttgccatcgtcaaactgccgcatctagctttgtggatgtgggagatatcctgtgatcttccaccgtcaaatgcatcctcggaggctcagatggtgcctgtaagtgttggagacactgtgcggcgctgggctggctggccaggcaccagtggcgtgcgtgacgctagagctgagcgctggaggctggcagtggcgcgtgcgactgtgcctctgatgtatgtccataggatgagagttggactgttggagacctagtgcattggtcaaatggaccagg

SEQ ID NO: 166 - DNA, 1026 bp, Zea mays
gggccggcgtgttcgtgcgcggggacgaggagacggcggcgttctacgcgcacctgggcgagctgtgcccgccgcccgagttcgtcaacaactgctacgccgacctgttccgcgacgtcctggagtactgtgggcgcagctggaacaggcaccgcgccgtgctggtgcacgactacttcagcaacccgtggaccagcatgtccgccgccgccgccgtcttcctgcttgtcctcaccgtcgtgcagacggtctacaccgtgctgccatactacagccagaattaaccgggcaaaaaacaaaaaaggcgttttgccgccgtcacacacaccgggtgtcgccctctgttttttcttttttttgcctgcaactacaagaaaccctatgatttttccttgctggctcctcctatacaatccatatgaatgatggcgtctggagcgtgatcgtttgcttgtccatcgaatccgtgcgcgtccacgatcgcatgaatccgtccaagattaagtaatggaacaacataaaaagacaatattagtaggatgttgaatcattttagaatgaaaacaagcatcatccctggttttccatattgcccaaagaacaacaccaaatcctaaaataaccagatttatggaatctttatcaaagctatgtaaccaatctccaaacaacaaatctacatcatttggaattgagtttaaagcaatttgcatcactctctaaatatatttagccaacgggcactcaaaaaaatgagatgagcagttgattccaaaagaccacaaaagcagcagctaacagaccctgacattgctttttcttaagattttctttagtgaggattttgtttttcagaattagccataagaacactattattttttttgtggaatcttaattttctacataagtttgtatggcactttaaccgaattacttcttaactgtgaaaacacggacttgactgtgaaacccttttcacccagaagccagatagttctttcatccttttcagagagcccctaa

SEQ ID NO: 167 - DNA, 1211 bp, Zea mays
agtagcgctgaagagcagcctctacggcatccacagcatcatattctgttacctgaagaagatcaggaattgaccaagccgttagacactaataaattatagaagcaatactcctaaatgaaatacataaagagaagggcaatgaggggaagacgctagagttataaactacacacaggcagaaactctgcaatcaatcataaatgcaccctacgagtaaacaaatggtcacataacttctcccaatgacaatcattatagataacataggtaatcgcaattcgtaaggtgaatcactaaggaggcttccaactttgtatatacactgatttggagcagtttgaacatagcctacatattatttgcatgaagaaagtaacaagactacataataatacaagatggaatcatcagtgcagtcttctgagtagaaagtgtataacagtagagatggctgataagaatttttaactcaccgtaattggttcctccatgtccaacatactaagaattgttgaccagcatttctccatattcaccgatgcaccaaacagccaccctaactaaactttcctaaatatatcaacatagaagagatctatgcacattagatacataatccaagagtatacatgacaaagaacatttattatttctccacacctgttcactagatgcttgcaatgctttatataatgacctgactgaatatccttgaagttcagatgcattactcactagaactataagagcatgccatacatcatccttcacatgattaccagcctgtggacataaaaaggtacagtattaattggaatctttaatttacatctgcaacagaaattcatgctcatacatttacagctcaattatttacttagcggaagggaaatcatatagaaacaaaggtgtgtgcaacactaaatgtggtagattatttggcaattggcattttggtttagtaagttggtcttgaatcttttcactggtggagttaccacatctggaaggaaaaggtgtgggtgacaaggattcgataatagacattgctggcactgtgtagatcatagatcagaactcccgaacatagtattccagtgaatgcttaatagtagtccgtaaccctgatcaagtatgctaatctttctctccttaagttaggtaaaaaaaacaagactactctactgaatatacgagcaactagtata

SEQ ID NO: 168 - DNA, 1176 bp, Zea mays
ttttgcacaagatatctcgagctagattacacaaactttaaactactcctatcttattagaaaccaaacttttcttttttataaactactcgtatataaaagtagagtgcaggtcatcagtttggagacgcagagctgcactatggccagcttctccttgaaaccacagcacaatggcagcagcagcaggatctaccatactatctgtagtgctactgcctccgaatggaggtcgctcctgcggtcccgaagcagtgtttcatggagctggaagaagcacacaaggttgcgattgcgatgctgtcagggttccaatgggggtgatgacagccgtctgagccaaaacaccggcattttccacccatcgatatggggggatttcttccttggttgctctagcagccctgaagaagctgctgcttcgtcccaacaaaaggttcatttcatctatctctctattctatatatggactgatcgaccacttatttcctgtcgtcccactatattaggcttggatggaacgatgcgatgaactgaaggaagaagtgggtcgtctgatggtagtagaagcaaactcaccattgcatgagaggctgcatttcatagacgcgctggagagcctgtgcttggaccacctgctgaaagaagagatcggtgctgcgctgacgcagatcgagaccgccggtgtcagtgacgactgcgacattgggacggtctctctctggttttacttgctccggaaacaccgccgcagggcgtcgccaggtaaataatctcagccaaaaaaacacgcacttgaggttcgtgaggttcaaattaaagacgccattgctgcatgcatgcatgcagatgtgttcgtgaggttcagagacgcggagggaggtttccaggcgaacgatcctggggacctactgaggctctacaacgctgcgcatttcaggacccatggggagacaatactcgatgaagccatcgcgttcgcgagaagccgtctggagatgatgctgccctacgtgaaagggccattgttggcgcatgaagtcagatcctcgctggagatcccgctgcctagaagggtcaggatctacgagtcaaagtattacatccatgcgtatgagacaagtggaacgctgcatgagaaggtactgcaacttgccaagctgaactccaacgtt

SEQ ID NO: 169 - DNA, 850 bp, Zea mays
agggttgcttgacttgtgtggtcgctctgggatgaagggtaagatgatgtattcccatcgccttttgtttctagctgtcttgctttcttaaatttagagttcagttccgattgctttgcaaattagactttttgcgtagatttgtactaggcttttttgcgtagatttgtacatgtgcagcaagcaactcgttgcagatgatctattgacaattatgatggaccttctaacaatcttctcttttcctttcaggggccttatgacataaatcaaccaaatgcagactgatcttagttgattttgtaagtagtgatgtattttaggttcatattcatgatattcttttattcatcgtctgtattacaaatgaaaaggacggaaaagtaatatatacttttcttacacagtagtgatgtattgtaggttcatattcattatatattgtttcattcaccgtatgtattacaaatgaaaagggcggaaaagtgcaagaacattgaacctctggttcagatctctgatagcgtcaagatgaaagggctgtttcctcagttccgttttgtttcgtttttggatgaattttccatttcttgacactacatgatttctttccagattgtatgggtggagagaaatgaaaccctgtacaaaattaatgatgcgggctcgtaatgtatgctgtccttgctattctgtctcgagaaaaatatgatgttccgtccctctggaataaaaaaacaaaaatgcatttagacatttcgggtacatgaattctgttttgagaaaaactggatgtggagggtttcagtaatcccagatttacatatttcgtccacgaaataatggactt

SEQ ID NO: 170 - DNA, 1278 bp, Zea mays
tcatgatccaattttgtttgttactatctgcaatttagaacaactatcaaatacgatgattttgtggccgaactttttgttctgccatcttgccatccaatggaaatagatgctaacagcactaaatcaaggcaccttagctgtaaagtcaagtactgctgaaacatgtattttagaaggaatgtaaaagatatttagcaaagaaaaacatttgtcatagaactaaaattccagttgctcactacggttgagtaaagaggtcacgagaaaaatacctaagcttatcgactggagtgcagcccagatcaattttacatactggacagtggtccagatcctcatcattgatcttattatagatacaatttctacaaactgcataatacaaagatcacaagaaaaatagaggtgagaacataatataaaaatattaataaggtacagcacaatgcttcatttcaagtagaatagaaatttgctgtctaaacagaagttcttttcagaaggacaggcatggcacagtggtgagaaaccttccaaccgagctaaaaggtcatgggtttgacgcaaactctctgcaaaatgcaggggtaacgcttgcctcagttattcctccccaagaccctgggagctgctagcattgagtctgtcctttaaacaaaagttcttttcaattgaaaacataatagatccatgtcatgacaagtaaaatgatacatgtaaaagaacaagacatgtcgatatttgtactagcgtggaccatacagcatgagattcatatggatcctactatttcaaaagcacacacaacatgaacagttacaccaattcactcacacatgcagagtaaccaagtaaattgcaactatttacagtctatgatggtacattgtggcttcaaaagctgtgtacagttccactgattacaggaaaacattcgtcgaacgcccactgaataccaagagggggtgttaatcctgaactcaaactggatagcaactcaaatcacagcaccggaggcttaataacgttctcctgaacattatctcaacaggaaccaaagcatttcacggattgggggcaaagatgggcaatcaacagcacgggaatcaaagtgcacgtaaaatgcacatgctgaagcccagcattgatgcaacattgcatcacgattcaataaagagaattgcagctcagcctggaaaggcaagaatagaaagcaaggaagctaccgtggtcaactcgaactagatttacgtggagtccagagtggaggtgcga

SEQ ID NO: 171 - DNA, 995 bp, Zea mays
atttgtttgattgaatgctctatgatttttttgcttgccctgttttttgctgtctccggtccataccagaactctcatgcatgcatcgtctgatatatctgtagctctctatgtggcgctgcaacgatgagcttcgcgttcgtgccgaagagctccacagttcgtctggttccaaagttaccaagtattacataggtaaccacaaacagaagcatttatgtttgcttaatttttgcctgccgtacaggcttttgcaaaagtctccactagtgttttcaaattaatttgagggctcttttggcaagttttctgaagtgtatttgctggcgcagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagaggtaaatatcgtcatgtatatatattatatatattcatagtatgacatcagcactgcaactaacaaaaaaaatcactatactgtcgtgcatgcatgcagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagct

SEQ ID NO: 172 - DNA, 1154 bp, Zea mays
agttccagcaaaagactgaaagaaagatacaagcaaatttagtcaatggcaacccttctggcttcaatcataaagatgacacaatgctcattagtagtagcgtgagctatatacaagaatacagctacattttgcacaatttactgtgaaaaccataacctatgccccagaacataaaatggaaactggaagataagcggaactacagttacttgacagcacacatccaacaacgatcctgcctttcctacccaacacacacacacaaacacggaaaacaaaaaaaagaagcagaaaagcaaaatgatgataagcaataattgtgaaattcgtagaatatagaatagaaatgggagctaggagcagcagtagttggcaattggcattagtagagatgaagacaaaatggtgaactcctatttgctttataaaaggaaattgaggaagatagcagttaataacatagctgtaacaaaatcagtgatatgtacacatgtaccatactgaaaggaaattgtggaagatagcagttaataatacaactgtaaccaaatcagtgatatgtacacatgaaccttaccgtaccacaacagtgacgttcttagtcaaaatttcaaatgaaagaacaaaatcacttactcttccagcacttaagagtgaacagctaggaggagatgggtgtccagtatttgcttcttgccctgcaacgaatattgtaatgagtatgacatgtcgaactattgaacttagaaaagcatcaccgaagcagttgtacaaaaactaattagattcccataaggaaaaaccactatatgttttcggattaactagaacttccatcaacatggcaacaattggttttctgacaaccagcaagcaatacagaatgagcagaaatgttgtcacactcaagtcacaatctcatatgagtaacggaccatgatttcggacgccgagcactgtcattacacatggatgatcaagcacatgcaaatattagcaacactacttatcaaggagaagcttccaactgaaattggaaccaaaacgcaaaaaaaaaattccaaggctcaaaagcatcaagactcactgctgactacccccagctgacgcttaagttttggacacagtaattcagccgatagaaaggatca

SEQ ID NO: 173 - DNA, 1223 bp, Zea mays
gtgcctgtggctcactgcactaccagaacacaactcgctagctctgcatcatccgtcgttctggtgagcgagcgagcgagtgagagacctagctagactgaccggcggccgccggcaggccgagaacgaagcgtttgtgcatgtatgaaagtttcgatttttatactgtcgtctacgaattgttccttgatataaatggttgttgttagtgcttcatcgatctgatctcagtgaaggagcaggagccatggcggaccagcagcagccacagcagcagccgcaggagatggacgttgaccgtaccggtggcctcgaactgcctccagggttccgcttccacccgagcgactttgagattgtcagccactacctcaagaataaggtgcacgacagggactacagctgcatcgccatcgcggacgccgacctaaacaagaccgagccatgggacctcccgagtatgtaactaacgagcgacctcgatcgatcgatctatctgtgcatgcagctagcggatgctgctgctagtgctagactaggcatgctagtgatcttgctaggtgtggactgactgatacacggtgcttgtttcgatcgcatgcatgccgcagaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaaaggcagggctcccaggggtgacaaaaccaactgggtgatgcacgagtacaggctcgaaggcagcggtaggctccctgctagtcctgcatccgcatccggctcagccaccaacatcgctgcggccatgatgaaagcttcagcttcggcttgcaaggtgcgtggtaccagtaatatatatcaatcaagttcagcaaccatgatgcatgcatccacatactactttctttgtttgcttgcccgcccacggtcacggcttaattacaaatgaaatccgcgcaggatgagtgggtggtctgtcgtgtgttcaacaagaccaccgggatcaagaagacggctgcgccggcataccaggtggccatggccggtgctgagatggatcagaatcagaacaacattccggccatccccatccccat

SEQ ID NO: 174 - DNA, 1107 bp, Zea mays
gcttgttgattggcatgcctgcagcggactctgcactgcacgcggtgtcgaactggagaggctgctggtggcgctgcccagacgacggagccacgaggcccagcgccggcacgtacgtaggacccatgcatgcatgctctccgtccggtaggcacacggtggtggccggacagctagccaccgtcgtccgggtctccgtacgaccgcgttgaactgtgcaggtacgtgcaggcgtggacgtcgagctggagcactcgcccagtggcccggccgggccttatctaccttgctcgtggactctggaattctggatcaccgtcgcgccccgcccgcattcattgctcggcgtctacccccagcatgcacacggcagatgagtaactgctggagtcgagtttatggttgcgtgcgacagtgttgtcgcgtcgtcggtcggaccccacatggaagcggatgcgatgcatggcccatcccccctagtggctcgagcagctgctactgtgcgcctgtgtgcccgcaaggccgcaatccatgtgaccatgccggcgcggcgcataccgtacggtccggaatcacggacgcgtaccccctcgcttttgtgcataggaaatgtgcgcgtctttctatgcgcgcgtgcttgcattttgcatgcatcgtcggccctcgccagtcctcttgctactccatccatccatccatgcgtcgaaatctatgccttggtccggccatgcgcggtttcgtacgtacttgttgttcttgggactagactatggacatgtctggtgcagatttttttaccggcttttcccagaatctagctgtggggagaatctaactgtgtagagaatctaattatcattaggattacgtgcagaggaagataacgttgtccatggggctcaagatttataaagtgacggattactactattacgacgactcaaccgattatatatttatgttgattttgaatgatttttatccaaacgaattttatagaaactgtctgaaaagctgagtgtttggtagtccgcagcagattttagtgaccagaaactccgaaaaggcgaaacaaacggggctatatgggcctgcacccgcagtcca

SEQ ID NO: 175 - DNA, 1070 bp, Zea mays
actgggctgcgagatgcataaacccgccggatgaaggatggagtgctttcacgttattgccgccggcagctgcgagcaagagtttccctgggtcagcgagggtcacggcagaggaagccgaaacggatccaaaggacatggaaggggttgcggacgaacctgacatggcgctctgctggtgcgatgcctgctgctgctgctgctgctgcgtcttgtcgcctggtcgcttctggtagaggcctagggcagcagcacctccggctcccggagccggaggagcgtaggtgttggatatgaagaaatggccttgcgggaatggctgctgtttcatcgatgctggctgcgtatgtgagtgctgcttgctcccaggattggaaccaggcgatgcattaggctgctggccaaggatggatggcatggccatactgaaatgattcgtgggagtagtcctggagccagacgtcgacgcggagttcttggctgactgctgctgtggtgatggcagttggacaggctgctgaacaccctttgcatttcctgtggcgggtgggctgccaccggtacttttggacaccgaattggatggtgaaccagaagcaacaggggcgtttgaagatcgagatagatcccctcctccggtagaaaggtttgttagagaaggtcctacctttgatgaacttaaggaagtctgtgattggtgaccaggagtgtagagagcctgcatagggacttttgcttgttgctggtggagactactgttcttcatcataatcaaattagggggtgtggcggcaggggtagtcgtagcagtagatgaaggtgtccctctccctgaggatgccttcaactggggggattgaactctcccttgggcagcacttgatgggtacatcatattctgaaaattagccatgtttatacggtcttggtacccacctgcactgttctgtgtacttggtgcagcagatctgggccgattcagatggtgatgctgaattagctgctgatgctgctggtgcttttgttgcgcttgcatctgaaggtgctgctgctgctgctgagaaatgctg

SEQ ID NO: 176 - DNA, 1319 bp, Zea mays
catgttcttgggtgttgtatttgcagttgctgagctccgaggtttctctttcaaatccagacatgctcgaatcggtgcagtagcattgacattcgcatctatgcagctagtaaatgcgtatcttcgaccgcataaaacagagaatggagagaccccgcctggaaacagagtagtttgggaatatctccatgttttgaccgggagatctgctgcgcttgctggtaccttggcgctctttactggcttgcagcatcttgggcaccgatatggcagtaagactatcaagggacttacatgcgggctaatcttatgggttataagtgttactttgttaacagcttactttgagtatatggcaattaagcgaaggacagcaggtgttgatggtctttcaggaaattgggtgcttggcaacactgaggaagatgatacagtcgaacttttgcaatctaacagggtagtcagtaaaatggagtctaatttgtcacctgaaccaatggaagtacagctcgagccacttaaaggatgagataaaattctcagcatgcatatggacataaaagtatgttaactaaaattctttatagatagaacgagcggcatatacgtctcaggataaaagaagtttcagtttcgcattttttgttgatataaagggaatattagtgagaatctcatctttgacttgctcgagaggtactatcatgccacatggtatagataggtttttcttttgtcttgtggagcttaggtcctcgtctttaatctcctaacttcttagcaacaatctatgtatacctgtacaattttggtatagttatcataattcataactgaaaagaggatacagtttttttctttctttaaatgtcacatgactcgagcattttcacatatggtactagctgacattatttgtttgtcatatgttgtgtatgtaaattatgtgacttggaactagaaacagccatccaacgaaaccacagtgctcctacattttctaaaatcagttatccacattttatatgtaggctacagttatcctttgtgctaacttttgccttcttaataccaaacctgtggcaatctatgccaacctgatgcattgggccatgtttggtaccaactgaaaggggctcaatgttgtgttgatctgcatcttggtatacctttgtacctgatttcatgatatgtcatgccaaaataccagaaatgcatttacttataaactacatattcatgtctgccttttatctgcaaaagctgctatgacacgcaggagaaagtagttgcccacttgtattccactaacagctcag

SEQ ID NO: 177 - DNA, 1204 bp, Zea mays
aggagaagatcaagtttgtcggctagattagcgattcagcctatattaacacgaacccgtggtagccacgttcatatttcctttcactctcaaacgaccaaaatttcaatggagaaccaaacgacggcggctgcggaggaccatatcagcaagctgccggacgacgttctcgtccacatcctctccctgtgcccttatatactctcatgagaacggtttcggtttcaacatcgtggcagcgcctcctctcccaacaactcccagacctgatcttctacttgtcgtatcctgtgcacaaggatttgtccatggaaacgccgagcgaggagcgcgtccagagcatggcgcggacgctccgccgccggtgccacggcacagcagcagactacactatcaagaatcttcgtctggtctacagaaaggacgtggccatggaatgccggtacgtagacgagttcatcgcgctcgccaacgccacgaagctggagctcgccccccacatgggcgccgagtccttctcctcctcacttgtcgcggacgcagccggcgactggtccgtcgagctgccgccggctacggtcgagttggaggtgcagccgttctgctttgccgtgaggccgccgcgcatccacggccccggcgtcaacgtccttcggtcccttacgctgcatgggcacacggtggttcgcaaggacttcccgctcgccgtcaccgtgttcccgtcgctggaggacctgcacatcggcaactgcacccttgctgccagtatgaccatctcgtcggacaccatgcctcgcctcaaacacctccgcttcaccgaggtcagcgtgagcgcggatgacaccaaagccgccatcaccgtgctcgcagatgacctgaggactctccgcatgtcatgccggcggtgtagctatactgtatcgccatcggagccgctcatgttcacgtgcggcgggcacggctcggccttgttcaccaaatactctttgttccacttacgcgcacccaagctggcggtgttcgagtggcgatgctgctatgctgatgaggtgcgcgttgacgccgtgggccgcctctccgacgtcgcgatcgagatcgccgccggtaggacgcggacgagggttcccataggcatggaacctaagttcgtgacagtacagcaacgtgacaaacttatgaccgacatccttcaagagcttatgcc

SEQ ID NO: 178 - DNA, 701 bp, Zea mays
attcctgcaacaccaatgttgacacccacgacatccttgatggttatgttgcttatggtgggaagcgcgttcctgtcgtagccatcgtcagggtgttcaccatagtttccagtgatcctgatggctatggaaacgtcgtcgaagctgacgtcagctacatacacgttcttcacgtaccctccgcgccccggggctgtcttgatgcggataccgtgcaccgagttgacgatccggaccccctccgctcggacgtccgatatgccgcctgacatctcgcttccaaaggcgagcccggcgctgttccttgtctgtcctgtgatgttgcggatgctgatgttggagctggggtgggcgaaggagatgccgtactcgtcccacccgctcttgatgacgacaatgtcgtcgccgtttctgacgtagcagtcttcgatgcagacgtttgtggatgagtctggatgatggggtttcaagctgcattagtaccacacatgcgacagagaaaacgaaaaaggagatcataaaggaaagcacacagttcaggacttcatgacatacatgaaatgtgtctgacaggaaatactgtgccatggtgccatacatcaagaaataacattttgaagtttttgaactttatgcaataactatggtcattcacttaattaggacatatatatatcagagaaaagaagggcaagcctaga

SEQ ID NO: 179 - DNA, 1165 bp, Zea mays
cttctcttctacactacaactgaaatactttgtcttgatgtaaaatatgctatagttatgctatgacatacaataaattgtggtattataaactacggttttgagaaacagagttcccaaacaggcccttacatgttgaattgatctcatcctattggggacataatgttgcagttatttaagttgatcaagtactgttattcacaggtcatgggattgaatcctccctttgggactaaagcctctcttgcgaaccagttcatcaacaaagctctcactttcaagccaaagcttataatactcattgttcccaaggaaactgaaaggtttcccatctccctatcgttctgcatgtttttttttataaaagatatctaaatatctaataccattccattcttggcgttggatagattggacaagaaatacccaccatatgagctaatatggcaggactcagatcagctctcgggaaaggtacttctaggcagtagtagtctccttgaatacatcatatcctcagaatgttgctatgttctttactgacattttctgttgggaaactatgcagtcattctatctacctggatctctggatgctgacaacaaggtgatggagcaatggaatgtgtcacctcctccgctttctctgtggagtcgtagtgactgggctgagaggcactccgagattgccaaatcaatggggcacatctcgaatgaaattggtgacttgcaaagggatctggctgcatctatacataccacagagcacgtggaggcagatgatgcaggggttgcaggcatgtctccatgtttactagatcagttgttgtctgacacgttccatgacccaacaacttctccaggggactgctggaatgataccagcggccgatcacggcaaccatgcaactacgaaacagcaggacaaggaaggggcgatccaacctacaatcatacaacagaaagctgctctgatatgagcatttcattgtcggagagtgatgttcagagaaaagatcaagcttcgccaatgccagagcatggaggcaccggctctgatatgagcatttcattgtcggagagtgatgttcggagaaaaggtcaagcctgggatgctgtggaagtgctctgcgagcggcagtccacggcattcaacctccac

SEQ ID NO: 180 - DNA, 570 bp, Zea mays
atctggcaatcttgttgatgctgttcgtgttcttcgacatctgcatgacgagcagatccatgtcggcctgcacacctttaatatgttactgcaacacacagctgaagcaaacatctttactctttttgccaaggtattcaggtacctgctgctttcagaacttactcctgattcaacttcatatatgaatgttgcattggccctccagaagttggatgactgtgaaatgatactcaaatttgtaagagaaattttggaaatcacacactctagagatgctacagttatgaatcgcattatctttgccacagccaaatacggacacattgataaaagtttggtaattttcgaagagttgaagaaatatgaaaccagcttggatgttgtcacgttcaacactgttttggacatgctagggaaagctggacgggtggaccaaatgcttggtgaggtgaagctaatggaaaaacttaggcattttcctgacattgtgacatacaatacactaataaactgcctgcgaaggcttggtagactagatttgtgcaaaaggtttgctttggaaatggt

SEQ ID NO: 181 - DNA, 1287 bp, Zea mays
tccatggactttggctaaaggacaagacaccttcaccccaattagtgcagtagtaagcaatgatttttcttccctgtgcttggagttggttggtggtggataaggacaatatgttttatttatttgtactcacttgttataattacacctcaatgaatcaatgccatattcaggttagtcatgcagaagtgttgttagataaaaacacttgatctttgttgccttccatgctctccgcaggcatctagtgacatgaaatgtgtaatcccatcattattacacaccatgttttttacttaagttaacaataatttctccatcaaccaggttccaaaatcagctgtcactaatcccgatgatctcgagctctggctgaaggtctctcaaatgtgtactgaatttgtttaatgttacctgaattgctagagcatatggtgtacaattgactaccaactgcatccaggtagatgatgaactaaggcagaaaggaccgacaagcgacatgctattcaagattccttttctgataagctatatcagttccatcatgacattaatggagggtgatgtgatactaacaggtagtgacatcttctctacgtgtagcttgtttttgcatctgaagtttctctgtggcttattcatttgttcctcaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtaagcaacataagatagtaaaggtgcatgcttttatttgttgtgtgactgaaaataatatcaggcaattgatttcatataagcaaaacctgtttacccatagcaagaccagtctgatcagagagggcaccatcgtatccatgttcgaggacatccttgaagatgtactacaattggacagccagatggtgtatatgtatagggtatagggccaatatgccagaactgtgttatggggcatcatcataacaaattgtgctaaagctacgttgtcctactccacattctcacatatacatatcaatcaaaacctgaagtacatgaactacttatcagttagaagctgtgctgtatgaactattgttaccgtgatttctttaaaagaatatatgctattgttggattagttataatgatcttaacaatttcaatagtaattattgatgcctatgcgggattcagcgacttaattatttctggctcgtgctgt

SEQ ID NO: 182 - DNA, 1141 bp, Zea mays
tcagggtgtgcagggtatgcgaccgctcagggccccaaggtccgtagggccccgtttatccatcttatatccaaatacatgtacgttgcggataaatttctattctcagttttttgttgcgtctctttgattttctggcaatcatctctttgaggtcgcgcagcagtctgcttgatgacaaatactaaaattggcgtgggaaggacggaaggtatggtacacctgtgcctgtcgcgttgcttaattctagcctaccggagggccgaccctaataatctatattgcttaatcctagtttagtttgctgaactttgtcttcagaaaatttgctctaatgtatttagatttggtttacggtgcattttaaggtttatgctagtttgacaaattaaaagtaaaaatactctctcaaaagtcaaaacaagtgcagagttatattacataatttgtataattttacgactcataaaataatgtaacagtgtctccagtcatcattttgaataacattgtgtaaatcaacaacttcttttattttttggatattatttaaaagttgaaaaaatagttgactcaaactttcgtatagggtcttcgtataaattttcgcttggggcccccaaaatgtcagaaccggccctgaccgtctgcgtctggctggccccggccggacggaccggacagatcgagcggcgccgttaactggaaggcgaacaagaaggcgagccagagagagagagagagagcacgcgcattgaggcgaggcccggggaccagtgcgggtggatctggaggcacggctgctcggtgctggggacctaaccttacccaatccgcctgtttcgttctctcattgcatgcctcccgccatcatcacgctgcactgcctgcttgctttgcttccatccatccctttcccttggttccttctcccttctccgatccatatggtattgctgctaccaggatattggatgccacacaaccatatgacgttggatttccggcagcccaaaatttagattgcgtacccctgcgctaatacgattgggagaggcctctgaatttctggttagattcccgccagccgcagcgcgcgcgacgtggctctaaatcaagagacacagacttgaatgctgct

SEQ ID NO: 183 - DNA, 1036 bp, Zea mays
cgaagcagctagagaaaaagagctagccatgcacaccgcggccaccaagcctctcctcgtcttctcgtcttcgttttcttcacgtccatggcggtcgtctcccatgcatcgtccctacgcttccaatacatcgaccgtcgtcacaacttcaccgccaagcaggcgagcacctcctcctcgtcgtccccgtcctctgcacacggcagccgcgaccgccgcccttcgttcgcgctagtgcgccgcgacgcagtcaccggctcgacgtacccctcgcgtcgccacgcggtgctcgacctcgtggcccgcgacaatgcgcgcgccgagtacctcgctagtcgcctgtcccccgcggcgtaccagccgacgggcttctccggctcggagtcgaaggtggtgtcgggcctcgacgagggcagcggcgagtacttcgtccgcgtcggcatcggctcgccgcccacggagcagtacctcgtggtggactccggcagcgacgtcatctgggtgcagtgcaagccgtgcctggagtgctacgcgcaggctgacccgctcttcgaccccgccacgtcggcgaccttctccgccgtgccgtgcggctcggccgtctgccggacgctgcgtacctccgggtgcggcgactccggtgggtgcgactacgaggtgtcctacggggacgggtcctacaccaagggcgcgctcgcgctggagacgctcacgctgggcggcacggcggtggagggcgtcgccattggctgcggccaccgcaaccgcggcctcttcgtcggggcggcggggctgctgggcctcggctggggccccatgtcgctggtcgggcagctcggcggcgcggccggcggcgcgttcagctactgcctcgcgagccgcggcgtcgtcggcgacgccgggtcgctcgtgctcggtcggagcgaggcggtgccggagggcgccgtgtgggtgccgctcgtgcggaacccgcaggcgccgagcttctactacgtcggcctgtccgggatcggcgtcggcgacgagaggctgccga

SEQ ID NO: 184 - DNA, 1000 bp, Zea mays
gcagtttccacgagttcctgatcctgaacaacacccaacaccacattcactagcgcaacccctgctccccttctcccaccacccagggacatagcccagtgcgacatcaaactcgaacgttgtcagcactggcttcttgaaaccctccccccagtcgatcgacaagcgtggacaagcaatttgcacccaggcatcaatggaatctccaaatagctccatcctcgccggggaaagctccgacatgagcaccactgtgtgttccaactctttctcctccaaatgctccaccaccctgtcgagaaccttggtgctcccctgcctccccagggtgccaagtacgactccccagctcttggccttcctggccgccagcaccgccgctttcctcgcctgcttcatgccaacatggtcatactcctccagcacgagaaccccgaggaatgggtcgaaacggtaggccttcaccccgggattggcgatcataaacgcctcgaggtggaacctcccgtcggcgacgaacaccacggcgcccacctcctccgacttcttgagcgtcggggcggtgcaacccaggatctcgccggcggacagcggcttcgcctgcggcacgacgatgtcgtggtagccctctaccgtgagcatctcgcgcgcggcgtggaccgcggcgatgaactgcacggtcccggcgatggcgaggcggggcgcggccgctgggtccgggaaggcagctcggacggcggcggcgaggcgggcggcgtccacgcggatctcgacgaagacgtagagcaccgggaggagtgaggccgtgacggggacgaggcaggagtggccgtagtggacgaggaggtcggcggcgagcgccctggcggggcggtcagcgaggcagcaggccccgtaggtggcgtcggcgaggacgaggacgtcgttgtcggcgccgggctcgaggtagggcgcgaggaggtgcgacagtgggagcgcgaagaggagcaggccccgggga

SEQ ID NO: 185 - DNA, 1112 bp, Zea mays
tggtttaaaaaatgatataatatgaatggtctaaaaagataatatagaagtatttcagcataatattgaggattaagataagaacatattaggttcacaggaaaaaaaaatgagggtgcttttgaaactcaacttggtgatggacaataaaataagattatttatagtttttagaataattgtgccaactggttgcaaatggatgcctcaaatgtttacacttcaatttaatcatgccacaggaaaatttgtgaaagtttagttccacactgagaaaaacaatccaactttatttattgatacctttatttttaggtgcaaacatcaaataaccaaaattctaacatgtcagtatttacctgataaaaggaagctaatctaacatagccagtcttgcactcatggccatcgtctgttctatgagagataattgcagttgacagaggtgaaaggttgataatttcacgagacagctggacctttggaaacaaaaggtagtggacataattaggaaacactcgatcactgtcttagttggaaaatggttctcttgtggttaatgaatttttaacagaatggctactgcaatttgatgagctctgtaggcacagatcatacatttcaaattacacatataaaaatcttaagattttacaattcttcgttcagcaagttaggcattacctccttttgtcttaaacccccacacctttcatcgtcagttccctggatataaatatgcatcggtaagaaagtaaatacaaagacgaggagcaacgtttccatggctgagttcaccaaattacataaaggggattcaggatatgatataatataatagaagcctagtatgccagacttcggtgaaccaaaaaaacgcgatgtttttttagttctataaaccaaaaccttggccacttattcaatctctgaatgttttttttaaacaagtgccttaatgttgaactggcacatctcaagttgaagtatacttcacaaccagcaaaatagatttaactgaagctaagtatctactatgaagctcaaggtaaggaaatacatctaacaacttcactttcactgttgttcctacacggcctctaagcctctga

SEQ ID NO: 186 - DNA, 1120 bp, Zea mays
agctaggtatctcagaagatggtgagcatttgtctgtatagcattcaagtacctgcaagggaaacaaatgagtatgcaaatttactggtatattctgaacatttataacattaaacatcaattcaaagacaaaaaatagtagtgacatcatactggattacagttataaaaaaattgaatctgaatcaaactcagttttttttttctggagaaagaaacgattataaaaacctactagtggaaaacagtgtagttttagacttccatgtataccacctaatacatttatgaggaagaactccaactgaaataaagcattcactattcactaattattgaatcgaaatatcaatgtgcatctaaacaaaaataaggaaatgtggaagtatattttaatatcttgagaactgttgataataagttgttgcttccgaaactactattgccagaatgctacaaatcacaaatcataattttatgtcagcatatgacgagtcttgagattttaacagacaaacctgtcctggaagaacagatcaatgatcccatttctaccattttcatggttaaagaagatgaacagagcccaatgcatcagccatatcctgttctggagctgattcagaggtgatgagaagttctgccaaaagataaggaaggaacaaggttactaatataacatatacaaagagcaaaaaacacactacgaaacattgatggtagaacctttgaatcaattatttccttcaagcggttgaattcctccaatgccacatcccagttctgcattaggatttctgctgctagctttccccatagggcactcacacttcgctcagtatctgtgcacaaagcacgatactggtacaggtactcagcagcccaggagtagttaccacactcaaactgaaatttggcatactgatacagagcttcaatctggtcaggaccaatctgcattgttaaacaaggatttagttcgttagcatttagcacagaagaggctataacaataaaagtgcacagcttcaacattccatatgaattttgatcttagttaatgtgcactgtgctttctcgacagtgctccagcagcaaaaactctgactcgggattgtcc

SEQ ID NO: 187 - DNA, 1205 bp, Zea mays
agcttgcatgcctgcagctagccaatgccttcgtatagaagcaaaaaatcacagaaaagtaagggccatgctgcccgctacttgttactatgattgctacctactactgtacatgttactatagcccactgctgtcatattgactaggaggaaggaagtagtcactgttcctatgagttatgacaaaagagagatgtgagagtagcagattattttacaatgacctaccacaaagatgcacgagtactccagtagtatagattctaatatagtgtatccacagttcaatgctgaaacaaagcttcacaaggttataaattcatcggcagaaacctcacttattacacaacaatataatcaggtagataagttgtactagtctgaagttaggccatggaatatttaaaaacgcttgccagcacaacattgccttgatttacataaatgtttaaagtatatacctgcatcaaaccccgctgataccagaattatatcaggatcaaaaactttagtgacaggaagcagtacatggtcccatgcagcaatataatcagcatcaccacacttgccatgctcccagggaacattgatgttataccctttaccagcttcttccccgatgaaacaatgagaagcatccccttcagcaggatagaagcttccataatcaaatctacaaaacaaacattagaacaataaacatttattatatctttagaacaatagatattttattatagcttcattaaggtgactacaagtgatagagataaacagaggttttgtggcagattttctattccattaagccacaccacaaaccatggaaggattgggtacataaagaagaagcaaacttggaaactaagaaagcttcagcgtatgctatagtagatgctaatctaggattctaggtgctaagaaagataagaagataaggtgctgacatatgcaccaactaatcctaagataagcacaaggcttagtctatcaacaaacacacactttcttttttttctcgaacacgcaggagagttgtgtatcattatatttaagagaaaaacaaaagtttaggccaaaagatggaccaaatacaacacctccttatggaggccagaagcaggcatacagaaaaagatccatcaagaaaaacagttaggcgacctctctcctaaactctgaactatggccataatattctaaga

SEQ ID NO: 188 - DNA, 1267 bp, Zea mays
tgcatgaagggcttctctgtgagatcacccagggactgggagctgggggaccgaagagatgggtgcgcgaggaacacccagttagactgcgcaagtgacacaggtctcacagataggttcttcgccgtgcaaggcgtcaggctgccccaagacgcaaacaaaatgcaggctgctacgagtggagatgagtgctcagggatctgcttgcgtgactgctcctgcactgcatattcctactggaacggagactgctccgtttggcgtgggaaactgtacaacgtgaaacaacagtctgatgcttcttctagtggagatggggaaacgctctacatccgccttgctgcaaaggaggtggcaatgcagaagagaggaatcagcgttggtgttgccgtcggtgtcgccatcggtgctaccgctgccgcttcgatcctcctagcaggtctgatgattcggaggaggaaagcgaagtggtttcctcgcacgctccaagatgctcaggccggcattggaatcatcgcgtttcggtatgccgatttgcagcgagcaactaggaacttctcagaaaggttagggggaggcagttttggttcggtattcaaggggtgctacctaggtgacccggttaccctgctggcagtgaaaaggctcgacgggtgccccccaaggagagaagcagttcagagcagaagtgaattcagttgggatcatccagcacatcaatctagtcagactgatcggattctgttgcgaggatgataagaggctacttgtgtatgaatacatgccgaatcactctctcgacctacatttgttcaaggccaacggtacagttttggattggaatctcaggtaccagatagctattggagttgcaagaggactgacctacttgcacactagctgtcgggactgcatcatacactgtgacatcaagccagagaacatactccttgacgcatcttttgtgcctaagatcgcagattttggaatggcaaaggttttggggagagagtttagccatgcggtgaccacaatgagaggcactattgggtacctcgcgcctgaatggattagtgggacagccgttacatctaaagtcgatgtgtacagctatgggatggttttgtttgaagtcatatcgggaaggaagaattcgagtccagagtactttggggatggcgattactcaagttttttccctatgcaggttgcacgcaagcttcgcagtggacacgttgagagtctggtggatggaaagctgcaggtc

SEQ ID NO: 189 - DNA, 1259 bp, Zea mays
tggagaactgttcaggaatcttcctctattgatactgtaggttcaattgcttcagcagttggcattgttttagacaatttttgtttgattctgcattgacaacaaaggttttcccaaatggtttcccacttaggttgaaaatgatgatttgattgcctacggcctgatcccagaatttattggaaggttgccaataacagttggcctgaccaatcttagtgaagagcaattggttcaagtagtaaatttctttgattttttaatttaaagcaatatttcttaaaattaccatctcaaatatttccaccacctcaaaatattagaaattctctttgcaggtgctcatggagcccaaaaacgcaataggaaagcaatacaagaagctattcaaaatgaatgatgttagtttgtgattcgttttggccaacgaaataattgcaacatttggccgatttttttttactttaaacgataatttataaccaagaaagttatttatgttcatgtttcctccataaggtcaagcttcatttcactgataatgctttgaggatgatagcaaagaacgcactcgcaaaagaaacaggagcccgaggactgcggcctataatggaggacatttgacagaagcaatgtttgaggttgacttgttttttgattttgccatgccagtgggtaatccaatatcagcctggttgatagcactttggtcattccgttgcagattcctgatggtagacacggaaaagagaaggttattgctgttcttgttgacgaagagtctgtaggaccactacactctcgagggtgtcgagcaaaaatttttcgggatgatggagccttggaactgtatgtttaccagaacaatatcaaactgcccgggctgattcagagcaaccccagacgcagacgcattttccggctctgccttctagtcgcattatcggcaacaaagctttggatttaccagacaattccttgtttttcatcgatatatgaatggattgcatggatactatgcaaggtctacaattttacacaataaaatatgatgaggttgattttcgtgttaaactgttcacacagcaaaagaatggctggaccccacgttctgctttcttcggtagcttgcaatgattttgcaacaacaattcgtatcatttacacgctactggtagcaaacagacagttgttttgatactgaacctgaacaaatggaaaatggtttccaatggttacacatcaaaattatgtttgta

SEQ ID NO: 190 - DNA, 1012 bp, Zea mays
cagcaccagaagacaacgaaatgaaacactcaacaaacatacatcaacacactaaatggcgacatctagtacctccttcaggatatatggagttgtagtgcacctcagcccaaaaactcaagcatataactgcacaacaggacttctgagtttagatagccaaaacctctgctcatcaacaaaaacacccattgggaaatatgcccgagatatatacagagtgagaaggtttacttaggcaaacaatactcagattttgatgtgagggcaggtacaacaactcgataacaattaaattagaaaataaacattacctcttctggatttctcaacaacaggaagaatctcaatataacatgtatctctgaatgatgtcaggatgaagatctttacaccgtactgcaaaagcaagtgcacgcacttgagtttcatatcatatatatacacaaaaatacaataaaaagggccaatagtatactatgatcccagtcccagaaattcaagcatgactgacagactcctttgattttttttttgtccaacaaaagaaattctaatatactcctaacagagacagcatggtagcagaagaagcgaaatcgcagcagatatttgaaacaacaggaatgttgaacagaaaaacagcatctgtaacatcatagctcgtttaatcttattttctgattgtgcctgcaatgaaaataaaagttgtatagatatgctgaacactcatttcgcgagcttcgcttccagctatgattttttttaattttttttttgtaatttcgtgtgcacttatgtactttgtaccctctaccataattgattaggcagaactgctgcctctaccataaaattttaaaagtatgctaaccactgaagccacataaattagccacacagggtacttgtgaaactggaggatttaattggtacctttaccaaatacatagtgtcagatgtacattaacacaaaaacaaaaagatcaagagcaaaaaaagtttaccgagt

SEQ ID NO: 191 - DNA, 1049 bp, Zea mays
cagcttgcatgcctgcaggcgcgatggcaagttggcaatggagccacggacgcccggacaagcactcagctttccgagaccgctgtcggctcgcgcacactctaataattaaacaaaccagttagacaggctctctccctaagccccaaccacttgccaccaggttaatcatcccgagagcgatagggaatccggccctcggattattctaatactactgctactcggctcctcctgataattgcagagctcctcttaaaaaaaacccgccatattctgcgctgcgctgtgctgtgcgcgcgagcgcaggaatgagatttgtgcaggtggcacgagctggctggtgggcctctgaccgtctgattggcgggaccacctgtgggctgtggctttgcttacagattctgcgagaacaaaacaaataatagccagaggagaggagaggaccctaagcaatccggtattgtgttgtattgtattgacggtaaacttacccctcgtgcaacaactgctagcctggttttgtttaattagtccaagggcgcgttggctgcgaggatctcgagacgtactactacctctgcctctgcctctgcctctgccgaccgatccacaacgccacatgctgctggaatgaatgattagccccgggagctggagctgcgtgctctttggtggtggggtgggttttttttttaagcgatggtacagtacatgtgaggataacgggattgggacaagacaggcggagagggggtgttatctggcggagaggaggaatgtgatcctgatccggatggatctgagcgccggccgtgtgttgagttgcttcgatggtagaaaaaatgaccgggcgttgtaagtgctgagtggttaacatgacatgatgatcggagccacggtgaatacgtctctgctgaatggtgcttgggatttttagtaacggcgacagtgagtggatgaaaaggaagaaaaagctccccccccccgcggccgaagttttgacctgttgacgaagagaatcgcgacacgtagtggaactgagacat

SEQ ID NO: 192 - DNA, 1122 bp, Zea mays
atcgacggcacgaagatgagcgcggcagcgacggcgagagagacggccacccatggcgacgggaagaagtgcagcacgaaccctccgcaccacccgctgacaagccggccccggtggcccgctacggcgtcaagcatctcgccgtagtcgtcaggaagccgcgccccgacggtctcctcacctagctcccggaacaaggccaccagctcggtgtccgtgcgccgcgtgctggcaaggacccctcgcttgcggagcatggccgcgtcctgtgggcaacgaatcaggccctccatccgcgctacgtgcgccgtcacgcatgcgccgtgcgcccagtagaagtgtttctcgaaggccaggaggttgtggagcacagccgcgctgtactcgtggacgtggaagcacgggacggtcatcacggccaccgggctcgccgggtgtcgccagaaccacatgtccaggtcgccgcagctcgacgacgcctcgcggaaccacaccgctgacctccgaagctccatggagcaggggaacagccgctccgactccttcttgatcttgaggagcttccgtggcgtcgagaggacgaagtacttgtccttgggcacgcgggaccagtggaagaggtgcaggacgtggtggaactcgccggcggcagcgctgtaggcggcgcgacgcgcgcgcttggggcagatgtcgtcgaaacatccgagcacgagctcctcgacggagttccggagcttgagcccagggcacgaagcggcgagaagcttgatggctctgaacgggacctggttctcgagcacgagcatgtcgagcttgatgtcgtcggcgtgctgcgccacggccatgtgcagtatgaagtagtccttgctgatggacgccgcccgcgtcacgctgtcggcgtcgtcgcctgtgccggccttgctgagcatcaagctcaccaccaggatgaagcagctgtccagcagcagcatctccagcagcttcgcctcgtcgtctagaatctccacggcgggcccgtccgagccgtcgtcggcgaactcacagcggaggcggtcgcgctccaggcagagcgcctcgacgtacccgtccacgtcgaggccgcactggtcctgcaggcatgca

SEQ ID NO: 193 - DNA, 1237 bp, Zea mays
ggagaagctccccgtggcgccggctcccgcgcctccgcctcccgccaccaccggcaccgacgaccccgacgacctcgtctctctgagcctcggcacgagggccaatagcggtggcggcgcaccacgccgcaagggccacgagaggtcggcgtcctcgtctggtggcaccgctgatgagatgaccaccgccggtgccggcgccgacgacgaaggccaccggctctccctcgggctcggcttcgggcgcggtagcgggctgccggcgtcgacggtggccacggacgacgacaaggccagccacgcgtccgtccggaacttgagctccgacagcagcggcagcgccgactacaacgacaacgccaagcctgctgacctggccgccgcgggcaccgctcgtaagagcccgagcgccggtgccggcgacggatcagctgatgacgaggtgcagcagcaggccaagaaggctagggtttccgtcagagtcaaatgcgatacacccacggtacgtgacaataatacctaggcttatgaaacttgagaaaatggcacacagtgttaggttattcctgacctaatttttttgtttcggtggtcatcaatcagatgcccgatggctgtcaatggcggaagtacgggcagaagatctccaaggggaacccgtgcccgcgcgcctactaccgctgcacggtggcgccgcagtgcccggtgaggaagcaggtgcagcggtgcgcggaggacacgtcgatcctgatcaccacgtacgagggggcgcacaaccacccgctcccgccggcggcgacggccatggcgtccacgacctccgcggcggcggccatgctcacctcgggctccaccacctccgccgcctcggcctcgctcgtccacggccaccaccacccgctggcggccgccgccgcggggctgttcggcccaaccaccatggtctccaccgccgcgtcctgccccaccatcactctcgacctcacctcccccgcgaccgcgccgcactccctcatgcactcctcgccctacgggttcgagtccaaggcggtcccggcggcgtggagcagcgggtacctggcgtacggcggcgccggcgccggcgcccacccgtcctcctactacgccaagagctcgccggcgctcgggcaccaccagctgttcggcggaaacctgagcgtgccatcgagaccggagcagaatggtacgcccaatcgtacctgcaggcatgcaagct

SEQ ID NO: 194 - DNA, 1056 bp, Zea mays
ggttgcagctgtgctttagctaaagcgaacgccgtgtatgttttttttttctggtcaactaaacattgttgtgtatacatacataaacagcaatcgaagcagacaataggcaacaaaataacgaattaatgctgttatcaaatgagccagcaacggataaacttgagatgctgccctagtagccgttctcaaactgaagccctcaaggcttcaaacccatcaattgcttgcaactccagccacaatcatactaataattacacttgagcgcagccaaaatagcaataaaaaagttgagcaaagagtgcacctgctttgcttaattgctctgcacgctcacgacgtccaaccgacgctacagcctacagcggcgtgaaaaaagaagagctgttttttaactccacacacggaacaggaattaccaaccgaccgacccagtgtacccgattcggaccagatcttcgtggaattcaccagatctatctagagaagaaacagggaaacaggaaaccagtaccttcccgccggtcgatgagctgatacgtagcgcgctcaggcgactggcccatggggcggctggcctcaggcggggcaagctaaaaagagccctcccgcccgccgcggttcgggctctccttcctgaacaaggtcgagttcggctccggatccggctgggccacggggaagtcggaggcggacgggtgcggacggagacgggggcggagaggtgggggtgagcggacagagcgaagatgggcgtggtcgctgtggatggaggcgaggcgggtgggtgggtggacgggtgaggccgtgagctgaggtgaaggcgaggtgaggtgagggagatggggtggtggagtttgacccgacgcggcggggggtggccgggtggggcccgcgcggccagtgtagggcgcggtggcgtcgaggggaagggtgcggcgcggtgggtggcggccagcctcgggatccgggtccagcacgggcgcacgcgcacctggcgatcggatgggcgtcggccgatacgaatatgcacgcgcacctggcgatccgggt

SEQ ID NO: 195 - DNA, 1109 bp, Zea mays
gctccttgcacggacccgatcagtctacctgcaggttgtactggccagctggtgcaatgtaacttattttccccatagaacccggtggaagagcaacatggtgctgcatcaatgtgttctcaaaaacagtctgcaacacacacccagtccgcaatcattaggatgtaaacacgggttaacagcatgcatttacatatcacagacagctagtcttcagaatgaagccatagatggaagtcaatgtcataagaacttacagcgtatagatctccacctgtgatgacatctccaacacctggaaatatagcacaagaaaacctatttagatagcatcaaagttcaaatacaacttagagataacaaaaacagcatgcaaaaccatttcaacaatggaggtactatgttaagtcactacctagcttcgttggctgaaattcccacaatacatctttgtcaagggcaggaactgaaacaccacgaggaatatacacatctcctgacttaatagcgatggtttttagaggtcgctgcaaacataatagagggcgagtgaggataatagacaaaaaataatgtaaatggccgcaaaagtaagccctgtcgtgttcagcacacctggataccgtcaaaaatgtttccaagaattccaggtcccaattcaactgaaagaggctgcatgggaatagccattacatgttaaatgatagcaaaagaatgatattaaaagatatagtaagatctgaagacaactaaaacaaacctttcttgttctcaatacagggtcattaaccatcagtccagctgtttcctcataaactgcaacacgcaaatgacggcactcgcgaggttagtaccgtgtattcaactggaaaggagcttttcatgcccatgggtgaataatttattatagatgatctgccatgttgcataccttggattgtagctgaatcgccctcaagacggataatttccccaatgaggttatcatgtccgacacgaacaagttcatacatggcagcaccacccattccatcagccacaaccacaggtccagagacctgcaataacccagcatcaaggctaatcaaagtggggcttgttatatacat

SEQ ID NO: 196 - DNA, 1199 bp, Zea mays
ctgctcggtccctgtgagcctctacagtcgacctgcagatccatctcctgggaagaaaattttacgccacatgtcagtactcgagcaagctaagcaattaaacttccagggagataaactagcgtgcagagtattgctgaactacactaacccttctttgcatatattcaacttcagcatacaagagctcattctgcatgcaagaaataaagggtgtattaattgctcatcagcacaaaagtcaaaatcgattacttaaaagcatattggttcctcataggcttggatgtatatatatgcacagctgcacacatttctagtctttgaaacaaattgcaaaaatgcctactttcattaggattttttttaaaatattagtgtcctcatttaaactgacaaaagaaggttacacatatactccgatccatctacaagctattttacatatctgtaccacagacagatatatcacacagttacttaatgcatacctttctagctctaatcttgtttatggccttctccagcttgccctccatctgcttaagctccctgaggcccatggtgtggattgaatctcccactatggtcctactagaccatttaaacaagttagactgcatatactactacaccttttgttgttgcgtaaaagaaaagccgaaacattgtatattagatttgtagaatttggtctaaatttgattgctgatacctgtttgcgttttgcaagctatcgatcgcctggcgcagcttgaaggactcctgctggtagtgctgcaagttaaagtatggatatatatatagtcagtcatcaaataaagcttcttctgcttgttgtgatgaataactgaccttatgctgatttttagagtagtacagaaaattaaaagaacatgacagagaatgtttagacttgtttgagctgaggaactattcatgatatactagctgactagctagatgccaaatcactaattgttgtttgcatcagtgaagcacagataagctccttgcaaaaaagcccttaaacatttctcaattttattttacgtttaaacagttatgtatataaactgaatatctttggacagaatcgttatgcagccatttcctaggatttccccatatgaataccggcgtggtttttaaatcgacaacataatcatgcccataaaaagcaagtataaagagagagc

SEQ ID NO: 197 - DNA, 1155 bp, Zea mays
atcatgaggtttgccgtcgtccatccttaagcaacgggcgcggcatcggcgcatactgtagcgaaacctgcaagaaggtgtgtacctgctgagtgctgcctagtctctccacttcatttggtttcttgtcggccgtatcagatctgttctgtctttttttttcaggtgtctgctcggttatcagacatggtaggcgtaacaaaccacaccgaagatggtttctcatgggctctgctgaagatccagaaagacgaggccgtcagttcacaggacattgctgctgttcttgaatgcaacgtgaagcttgcggtggcgcttggcgtgctgaacgagtgcttcaacccggccaaggatcgccgaactaagatcgatatgctccaccaagctgtctacagcctcgggtaagttcagtcagtcagcactgaaacatctgcgtctcttttcagttcttcgatagcaaaaaaggtttgtgcttcaacagatcagaattcaaacgggtgagctacgaaggattctacaccatggttctggacaaggatggggaaaccattgcagcagccctgctgaggtttggattcaggagtacttgtcagtgttcctggcctagtcgttgttgtatattactgtaagcaaaggtcttcttcttcttcttttttacaggatccatggcacaaaggtcgccgagatgccgttcgctgccacgctgccagcttaccggaaacaagggatgatgcgtcggctggtgaacgctgtcgagcaggtaggaggagcacgacactgtctgcctgcctgcctttctgtatgccactgtcactgttcaccaggtgtgagtgtgaagcaggtgctggcgtcagtgcaagtggacaagctggtgataccggccatagctgctctggtggacacctggacgaggtccttctccttcaggcccctgctggaccccgagtcgagggaggaaatcaggaggcggagtctggtggtcatcgccggcaccaccctgctccacaaacccgtggccgccgcgcggccgccgtcgccacacagacacgctgaagcagcggcgccgaagaatgcagggctgccgtggtggtggaagtacacgcagcaggcgccgccgctcacggacgacgagcgggccttcctggacacggcgcc

SEQ ID NO: 198 - DNA, 1068 bp, Zea mays
ggggatggcggcggcaaggagacctgggaagatggtgcatgccctcatcgtgacaagcggcattgtgccggatgtgttcgtctccaccgagctgatcagggtctacggggagtacggtgagctggcgctctcccggaggttgtttgatgcgatgccggtgaggagcaccgtttcgtggaacgccatggtgcatcagtatatcaggcatagtaatgttggcgatgcttacgagctgttccttgcaatgccaaggagggatgtagtgtcatggaacacgatgattgccgggtattcccttgttggtcgatttatggaggcactagagttgtcccgccagatgatatcgccgtcgtcatgtccagtgtatccaaatggacctacaatgagcactgtccttgctgcttgcgggggtgccggttgtttagagactgggatttgggtccatgccttcgttgacaggaaccgcatgaatgatgatggctcattggatcggtccttgatagacatgtacgtcaaatgtggaagcatcgaaaaggcacttcaggtgttcgagaaggcacctgagacgagggatctgtactcatggacgaccatgatttgtggactggcaatgcacggcagggctgctgatgctctaaaaatgtttggtatgatgcaagacaatggcatacaccctgatgatgttactcttgttggggtcctaaatgcttgtgcacactgtggacttgtggacgaaggccttcgacacttctactccttggagaagtatgcaatcacacccaaaattgaacactatggatgtgtcattgatcttcttggtcgtgttgggcggctgcaagaagcatacaacattatcaggaccatgtgcatgaagcctaatgcagtaatctggggtgcattcttgaacgcatgcaaagttcacagcaacgtggagcttggcgagatcgcagcagctgagctcaccaggttagatccaggtgacccctgggcaaaggtgatgctgtccagcttgtatgcaaaattgcaggactggaacagtctagccagggagagacgggagatgaacaa

SEQ ID NO: 199 - DNA, 1107 bp, Zea mays
tggaaaaaggcatgctttatatttccaaacatgatgtccacacgctcatcagaccttgaagtagaatatctgaaaccattgaaatgagcctcaagatttcctgtgagcttcctcccacgaccaccaaatgcaggtcgtatccacacatcagaaagcctcatcatcttcattctgttgcttccaatctgaagtttctcctgggtaacaagagttgccctttcagctctctctgactcccttgatgccacttgcctcctcaacgttttgatctgctgaacaacttcactgctatgccgtggatcttttgagcggaatgtaatttctttcagatagatagcaccttgagaattaaacttgctatcatttgagaatggcatgccaggcacattgaagaagatacggatagtgcatgtgcggttgtcctggtgactggtcacactcttgacagtagaaacatggaaaggaaccatactaccataaataggtaagaggacagcttcattcttctgatctacttggatcaccaaatctcttacaaatggtacatcattaacattcttatatgcaacaagctcatttgaagccctcgcaggaccacgtccgtcaccagatccagtaccaaccccagcaagccttctagcagtctcttcattcttctggcgagcaagttcagcctggtgctgtctcctgagctcttccttcgacatctcctggttgtctgacctgagagttgccttggttggcataacatctatggtcttcgactttatcttaacctcagcagcaacagcatcatcatcttcgttgaacgaataagcaacatctttgaatgccttggagcagggtgctgttaagacctcatgtcctctttcattgactaaaactgtatcagctaataatagtgaaaactgctttgtcttctcactggttgtttctgcctggatgttatgcaaaccaagggatacattaaaaaccattcccttttttatcctgcgatcattcttggcattcagatttaagccagattctcggaattcaaggcctattccagttccagctgactttgttagattaggaagaagttcaggtgcatccctctcaatcaca

SEQ ID NO: 200 - DNA, 1221 bp, Zea mays
cttgcatgcctgcagttattatgaaaacgattttgctctgtcatttcgtaggcatggggggtcaaggggacatgtgctgccatagccatatagctcctatatatgcctacttggattggcccacagtacacatggagcgaccatgtagccaataggcaaaacataaaagaaaatggctaatttctggtagtattttgttaaaagtcacattatcaactatgttttgaaaagtttgttatgcactcaccctcggttggccactttattttgcttcacttcacataaaacacaactactctgtgtctaaataattcaactgtagtctctagtcttagatcatatattttaaagtttgatcaaatttatggagagtagatttatttgggccagagggagtaagcttcttagtgtagattggcaccatatagcttcgccataggtgaattttgatcctagatccgccattgcttggaagattgttgattcattcagggtattaaaccattggcttaggcatctcaaatgtcacgaatcatgatgttatgatttatgaacattctattgcacggtaaattagtgattggggaggggggatgcatctcagtagtgaccacattatcatattatcacattatcattgatgtatggtcagtctagacataacatgataatgtgttcactgctggaataggttagtataggcattatattctactttattgctccatgtaatgttaataacattatgttattaggctgaatgagtcattgatgacatttccttttccagagacatttgaagttgatattacaaacacaaaaaagcttctggaaggtgaacgaggacaggttatagctcaaaaggatgtaattgtaagtattttctttgacatgagtctagtgaaaagcaaaaaaaaaaaaaggaaaggaaaagaaaagaaaaggaaaaaagtacgtttcctctgtgtttggctaggactacgctccatgttacatgtgcagagctattcacagatcacactttcacaaatcataccttgttgcacagattcttatacaaaaaataaaatgaattagtgaagtacaatgctaaccttgcaatgctagtattctacaattaggtttactgtaaatgcgttgatagcacggtggtatgtcctctgtttgggaggatgctaaccagggttttcaaatcctaggtcacatgaaaaataggcgtct

SEQ ID NO: 201 - DNA, 405 bp, Zea mays
attgtggatgctcaaggcgtcatcattatctgggactagattttgtctttgtaggggttcaggcgccactcccaaccactgtagcctctctgaccagtaaaattggtccatcaggaaaggacatgttacctgcacgaaaagatttagtacaatggatccatctcaaagcatcatcaagaaaatgcagaagctgggagataacgtatttgtttgagtcggcatcagaacattattttttttttttgttatagaattaccaggcttgatgcttcctacacatccaggtatcacaggttgcgaataaataaaaggacaagaaaagagcagcagaaagacagccgcctcaaaacatggggtgaagctgtagaaagtgttgttgtcacctgagggataccagcaagtagt

SEQ ID NO: 202 - DNA, 437 bp, Zea mays
gttttctctgttcttccttgttcagaaaaactgaatgaactgcatacaaccaaaatgattcaatcaagaagtatcctgagcgcttatcgcgacgtgcgtttgtgcatcttctccacgctggcacgatgcgtccatgtccgcatacttctgctgttctgcgtccacaagaatcggagctcgcgcgcatgcaggaaatgaacacaatgcaggaacagctaaccgaactaactgaatcgcgtgcacaaagcttaacaaatcgaacacaaaataggtttagcagacgtatggttttagagttcaagagctcaatgtagacatcaacaaaagttcgtctttaattcagcgtgatttacatgacatacaaaatttactgtgctacacgtgttttaatagatgtgtgcatgcttgcaggttatcctggcagacaccattgaagc

SEQ ID NO: 203 - DNA, 329 bp, Zea mays
aaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaagtatgtctgccctattggcatttcccctcaaatagtttaagttatgaaccctacatcacatcatctaatgcatgtgtttatttatcttttcttattcctattcagaagctactcctaagggtgtgctaaagcttatgaaagttgatggtttgactatatatcatgtcaaaagcc

SEQ ID NO: 204 - DNA, 408 bp, Zea mays
tagagttgtgctcctcaacatccatagccccctgtgattcctccactgtgttacatacagttgcagtcaaaatttcagaggattgaactagaaaacgtgcagattagcatcggttgggcagatacgtcaccctttgcttcttgcgcagaaggcagaatcatctcctgctaactttgatcagcgaacaaaacttggttctctccccatttcaaattttaggcatagtttaacagccaatctccaacaataataggctgataactggaataacctaaagtaattttaaattatcgcaacaatggttctgaattataatactagcattttgccctccaaagcgaagagtcagaaccaactccagggaagaaaatacagcagaagtaatgtgtatgaagaattgaagataca

SEQ ID NO: 205 - DNA, 1145 bp, Zea mays
tgaggctactactcgtcctgttgggattgatacattttggacatcttgcaaccgctgccggatgcagtatgagtacttaaggatttatcttaatcataacctgttgtgcccaaattgccataatgcattcttggcagtggagactgggttcccttgcaatggaagcagctcatcattctcatggtcaaccaagcagcagccgcagcagaaccacaattcaaccaagcattcatatggctcaacaagcaggacttctagcatccctggtacagggaatggggggtaccagcaagataatacttatgattcttacaacaatcaaggcttccagtggaatcagtactccaagacaacaactgcagcttgaagtggcaaaagagagcagaattcttaatgttttggagacatggctgcttgggcgcttgaagaaatgctctctggctcttgcctccttaatccgctcgatggctaggactagatcaagaattgcctggctcaaagatggtgatgctaatacaaagctcttctactcttggtctcgttatcggaaaaggaaaaatttcatagccaaaattcatgacggggagcagctagtgaccagtcatagtgataaggctgaggtgtttcggtccttttattctgatttaattggtacagggcagcaaaggtccagaactgtcaaccttgacaccataggactgcagacttttgacgacaacggcggcgccggcgcagaccccagcgacatggtcgtcatctaggtctaggcttcctcattcgaccgatctagtactactactactactccatcgattgacatgaatagttctcgatccgccacttattaagtttattagctagcttgctcatccctaaattagctgccgacttttttagctagctatagatttcagtagcttatatactagcttgttggttctgattagagctgcaatatttcatgagtcgtcgtcgacgacgtaggtattacgtataggtacgtgatgctttgcgactgcaatatttttgcatggcaatgcattactgctaaggtcgacgtacgtacaagtagactagctagcatgcagtttgaacttgttggcttttaatcgcatgtgtcaaagctcagtttgtcgtactgcggc

SEQ ID NO: 206 - DNA, 810 bp, Zea mays
tctattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggtaacgtctctccgcttcgccccgtcccaccaaactcgtcgcactaatacaaaacaggtgtgtgcgtgaatttaaagctgcgggcacttggataccttaatgctatgtttgtgagcaatccatttggggaactagggataaccactaaccagtaagctttatcgatgaagcacagcatttaaacctgttacagactcctagtttgcatcccatcctgcagtgttgatgtcagaggttggcaatggtgcgaatactcttttttgggtggataaatggattaatgggaaaaaggtagctgatatagcaccaagattgttctgcaccatatcaaaaagaattgccaataaaagaacagtgcaagaggcaatggacaataggagatggattagtgatattaggggcgctctctcagcaggggccttgattgattttttgcatctctgggaagctttaacggatttccaactgcatcctgatattgaagacagacacatttttaccatagcgccagatggtaactactcagcaaaagttgcttatgaagggctcttccagggatcgtgctcctttcttcaccacaaaagaatctggaaatcctggatgccacccaagtgtcatttcttcctgtggctggtggcacatgataaatgctggactgctgatag

SEQ ID NO: 207 - DNA, 445 bp, Zea mays
gttgccgatagaggccgcgatggcgaccatcacggcgccccccatggccgccggaaatctacgcctgcacagacacacaccacgcacgcgacagcagcgtgcgtcgtcagttcatcatacatcaccatatcataccagatcctgcaaacctccagcagaggagacgagacgaagaacagactgcgctcggaaagagccaggctacaaagagcaaatcgggctcgaagagaaccaagcagcctacgaagaacgcaccccaagcaggagggctctcgcttacccccactccggcagcggcggccaaggttcgtgatccccgatcgggcgcggggccttcttaaacagcggcggcgggtggtgaggtggccaaactggagtaagcgctgcggtgaattttagcaacgccgcgcgttggggttggagagcgaggggtgcggagcagggc

SEQ ID NO: 208 - DNA, 888 bp, Zea mays
ccgacgcctcggctaacctctccagcctataaagcatcatcctatgagcctgtactttccttccccattgctactcgcgccttccccactctcgtgctgcctcgctctctgctcatttctgttctgctagcgccattctttgtcgcaccgtcgccggggtatccctgtgctgtgccgtgcatcgctcagcatgtccatcgtcgtttctccctcaccggtgccgagccctcgccgaagctccaccaccgtgctgccataattccctgctcacgcccttctctattgctattaccctgcattggctactcgcccatgtctgcaccacaccatgctgttacgctcgctaaacatcctgccggtacgtgccgtattgcccacgcggcatgccattgccgatgcagctcgctgtcgttgtgcttaagccatcaatgccttatttcgcttgttgcccagcccagctcaccctgcagcaaacccatttgaccacaatgatccatttgccatgtcaaacagctttgcaccaccatcaaatgtgcagttagctatgatggcagagcagcagcaatattaccatgcacagcagcagcagtattatcagatacagcagcagcaccagatggtgatgttgccgcctcaaacataccagcagcagtcgcagtattctgccccttctcaatctggattatccaatccttttggtgatccattcagtagcctcgtcacgatggctaatccaccaaagcaaagcaattcaaatttagtctgaattgcatttttttttgtgtctattgctcccactaattcagaccatacacaacattgacaattttgaggagcaacttgtacagttcagaaactttgaatactgtatcttaacgatgcgctgta

SEQ ID NO: 209 - DNA, 466 bp, Zea mays
  misc_feature (54)..(54): n is a, c, g, or t
ctgcattaagcttgtgcactgcgggtctgcggctactgttatttgcacctttcntttttgcaacggcaattcaatccatacgatttcttacgttgttcataaatcgctctcagattacaaaacagggatatcaagtacaattcaaaggaaaaagaattccagcgcagggacagggaagctggaagacggagcacgacactattgctggccctgtcggcgacgtacaggtgcggagaattgcatttccatccagcggctctcaactctactaggagaaaataacaaattttggtactgcaagcgctacaaaaattaagtacctttattttatcaaaatgattcctggccagcttcattgcatcggccgttccatttgacctcattattttgtacgagcgatcggttgaatccgaagaaaaaaaaagcgaattgcatgtgtgtatgctggcgtgtacttcccgcagat

SEQ ID NO: 210 - DNA, 845 bp, Zea mays
gcaagtgcaggtcagtgagaccgcgaccacgtccttcctcctcgccgtgcaagtcgatcactggcattaaccgtgggcaacagacacgaatactgcctactggccacgacctgcacagcacggttcaggttaaccgacccaaaccaaacgtttgccgcgcatgcagatgatgtggatgggcagcgccggcatcgcggcgccgccggcggtgatgttccccggcgtacaccagtacctgcctcggatgggcgtcgggatgggcgcggcagcggcggcggcgctgccgtccatgccgcggctgccgttcatggccccgcaaccggtggtgcccagcgcgccggtgagcgtgggcccggtgccggcctaccggggccacatgcccgcggtgggcatcacggagccgtacgggcactacatcggcgtcaaccacctgcagccttgtggtcctgtgaagattctgaacagtttcagcttttctcatgtatgcaggcaccgtggttccgatgcttgaggcagctatctccgtcgttcccgtggagaagctcgctgtccacttccacgacacctacggccagtccctctcgaacattctcatctctcttcaggtaacaaaccgagaataccatttacacagtcgaaagtgaaaagtgatcaaaccggtgtcctcttgtcaaccagatgggagtaagcgtggtggactcctccgtcgccggcctcggtggctgcccgtacgcgaagggtgcgtcggggaatgtggcgacggaggacgtagtgtacatgctcaacgggctgggcgtcaagacgggcgtcgacctgggcaaggtgatggccgccggcgagttcat

SEQ ID NO: 211 - DNA, 426 bp, Zea mays
aatgccccagatggtgaagaggtcgcgcgtctggaatgccggcgcgatgcgctcgatgtacgcgcggccccggatgacgacgaggcggaagttggcggtggcgcgcgcgcggtcgaccatggcgcgggtgatgcccccagcggcgcgccatgggtggaggtcctcgtggatgaagcggaagtaggcagggcaggtggaggaggcgttggagttggcagggagcggcggggggtcgggaaaggcggcgcaagtggaggcggaggaggcgttgggggagagcacgaggtcgagggtctgggagatgttgctggggatggtcgggtcacggtgaagcggcggcgccgggcaggagagggagtaggtcggccgaggcggcggcggtgccgcggggatggccgggatggaggaggtggtgtgcgtcgcggt

SEQ ID NO: 212 - DNA, 475 bp, Zea mays
gctcacggggatcaacgtcgtcatgttctacgcccccgtgctgttcaagaccatcgggttcggcggcaccgcctcgctcatgtcggccgtcatcacgggcctcgtcaacatgttctccaccttcgtctccatcgccaccgtcgaccgcctcggccgccgcaagctactccttgagggcggcatccaaatgatccttgcacaggtacagtacagtccttcagctagggccagcattcttttcttgttgacgacgttggcaaacatgttgtacaatgcaatgcaatgcaatccatgcagttcgtgcttgggacgctgatcgcggtcaagttcgggacgacgggcgtggcggccatctcgcggccgtacgcgatcggggtggtgttctgcatctgcgtcttcgtgtcggcgttcgcctggtcctggggcccgctggggtggctggtgcccagcgagatcttcccgctggagatccgct

SEQ ID NO: 213 - DNA, 422 bp, Zea mays
atcctgcccacgcagaagatcggcctcgtccagccgctggaggagctgctcatccactcgttcccgctgccctccttcctcatctggccgggctactacgtgctctaccgcttcatcgagaagcacggcgccgaggccgtggcctacgccgaggcgcagcacggcatcggcaagaaggacgccatcaacaacatgctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaaggcaaagacggcgagttcgggttcgccaccgtccgcgagggcatgccgctggtgcggtcgacggtgtacgagatgctgcggatgcagccgcccgt

SEQ ID NO: 214 - DNA, 379 bp, Zea mays
tgcgcagcctacagatccaaagctacgtactgtactctaaattccttgctgtagtacgtgaaacgtgatgcgtatccggccggctcccgcgagacaggaagagacagcgactcgcagacttgcagctgcccagcaggcagtagcttgccctttttaatcgcagcacttggggttgacagtcacacacacactggtcgcggcgcggcagatgaggcgccacaaatctgaaccagcatacagttagggcccatgatttcccccctttctctatggtttttatatataaaaaaactgatttatatgaaacttttgtatgattcctcctaaattcctgcatttcaaataagacatcgagctagtgtaagcgtaggcctgcaaa

SEQ ID NO: 215 - DNA, 379 bp, Zea mays
tacataatcggctgcatgtcgacatgcgacgacccactgaagaacggctcatgctccggcaccgctggctgctgccaggcggagctcccgccgggcgtccagttttaccaaggcttcttcaactcgctgcacaacaccaccaagatatggaagcaaacaccctgcaactacatcaccgtgatggagagcgcggccttcagcttcagctccacctacctcaactcgacggtgttgtacgactccgacgacgggaggacgccggtcgtgatggagtggggaatcacacggcagacgtgcgaagaagccaaagccaacaagactgcgtacgcgtgtgtcagcaaccatagcgactgcgtctacagcgatgccgccggctacc

SEQ ID NO: 216 - DNA, 392 bp, Zea mays
gctcggagaaggacgcgacgttgctgaagtcacgagccgcctcccgaaagctcgccgcaccgccgccgccgccgctgtctctgccttcgccgccgccgcccatgcaggcaggtgtggagcgagcgagggaggtagcttggcttggctaggtacagaactatacgtcttctcgtgtatctctgcggagtagttttcagtaccgccaccagtacgtaccaagaaggaagtagccggggtgtctcatagctggtgtgtggctagtagggaacgagggtgcatgggaaagcctcctcagcacccttccttcgcgatcgatggatggtaaggactgaggagagcgaggagctgaaggaagcaatggagaggagagaccagggaatataagcaagggc

SEQ ID NO: 217 - DNA, 389 bp, Zea mays
ggcgcctgcatcatatatgtgcagtacagcagcaggtatgcatatgcatcagtcaaagaaatacgaccggcatgaacctactgccactgatctactcctataagtcagcattgttaccgatgaagaagccgtagttgatggcgtggttgatggcccagccgcccaccgccgccacgatgatgtacatgcagaagttgagcaccaggaggaggccggccaccggcctcatgcccgcgttcgccatggattgttgtcctaacggactactgatcgtcgatggccgacgagctcgactgaaaacgaattgagctcgatcgctagctcctagctagctacagcttgctagctctacgcctctctacgtacgatttctgctggcttgaggcgtc

SEQ ID NO: 218 - DNA, 418 bp, Zea mays
tgcctggtttgcatagtaccttacgtcgacgtcagggtcctcgctgagctcaacgaggcacggtttcacggtcttctccaccacctgcggagtaagcactgatgatattccccaataccatgaaaaatacagatgtaccgccttcttcgaaaatgttggtaacatgtgggcggaatagcttgaggaactcacagattggtcgaggatcggtacaagtgactgtagtactttcgcaacattgaacttgatgttgggaaccctgaaaaattttagaccatgttgttcagaaactgacaagattagatttttctttaacattcttctagtcacacacctgtccttcgaagaattaatgacgactggaagcagcttttgacaggtgatctctgcacccatgacaggagctagcaaggagatt

SEQ ID NO: 219 - DNA, 458 bp, Zea mays
aatggtgtttgtgctttgcaaaacgaggtgcagcaatggtgtcggcaaggtcgagcttgcagattcaccattggcagtctgtctgcatattttttttagataatggaaacaaagttcggccttggcctcaaacgaggttatggccaaagtttacaataagaggcagcatactgccttgacagttgacacatcacacgacttcactagagaataccagtgacataaccaaaggtactacatagttaaacgcaaagcagaaccccatccgaaattgcgaaaaaactgtagtagcaccatctccatactacgacatgaagaatttattaacccttgctcctccatcttaagctgttgaccagaagcgacaccagaaggttacctgcaaacaagatttagtagatgatttattgaaaaccacatcattactactcaaccaaatggcccaacaatttgcagat

SEQ ID NO: 220 - DNA, 648 bp, Zea mays
tgacgcaaggttagcttgttctctgaattcgacgaaaatgctactgtggtttgccattggatggcgtttcatgattcgattaattttcggtttcagaattatcagaagcgacctcaaagctgaagaagccgtcacgagtggctcgcgacatgttcccgacgcttcttgcagagatcgagaagatcgtgccagacaagtgcgatctgttgcaggagtcatacagcagattcaaggtaaattggtaacagtaattttcacacgacttgtgaataaagtaacgtaggatacgtgcaagttggaaagacttgcatcatttgtttgacaactttgcctacttcccttacattatatatatttatcggatcaactgatttgtctgctgacaacttccattgcatgcgcaaaatcagctgttctgttactgtataagctgttacattaggaaaatatatacagattttgcgttgctactcgacgagcaattgcaatcaactttacaattctgaaaaaagagcatgagttgattgtttgggcgtggtaaattgatgtttatgtggagggcttgatcataaattcataataatgctctactcgtactggttaacaacacagcagcagcctaaaacttcctttaacacaattttttct

SEQ ID NO: 221 - DNA, 634 bp, Zea mays
tgcagctaaggaacactcacagtaaatccaccctccttatggaaaaaggttgcagaggcacaattcaaccattcagacatgaatgtaaataagaaaacaaattcggaaaaaagtgaaatcttagagcacaggaaggtcatgaaatcatcagttgttgatttgtttcaacatcttgtcatcctcgcatttgcttaaaaatatgctagcctaacctagttcgtatggaactgtttgttcctctgtgttggaattagaaattgacagatacacaccaagttatcatatggatgaaaggaaaaaacatgttcaaaagtcaaaactatgtctaaccttaaccatgttctacccagctcaggctatgaatatgattaaatcaagtctactagaaaataacacacgacacagttatgagaatcgtgaatctagttatcttccgccttattttcttaagaactggaatactgatcatgtccaacttagtcaatgaagtacatatggatcgttgtagttttgcatcgttcaaaccgacaacttattttcagaattacaccagcagactaagagaggcatgtttaccttgccgcttcagaacggagctcgctagaggagcggtgtccttgcttgcactaaggga

SEQ ID NO: 222 - DNA, 698 bp, Zea mays
gtgcccgccgagcccgtctacctctggacgctccccatgttccactgcaacggctggaccttcacctggggcatggcggcgcgcggcggcgtcaacgtctgcatccgcgacgcgcgcccagctgacatctaccgagccatcgcgcgacaccgcgtcacccacatgtgctgcgcgcccgtcgtcttcagcatcctcctcgacggcgacggcgacagcgacggcgccgccaggcagctccaggcccccgtccacgtcctcaccggcggcgcgccgccgccggccgcgctgctcgagcgcgtcgagcggatcggcttcaacgtcacgcacgcctacggcctcacggaggccacgggccccgcgctcgcgtgcgagtggcgcgaccagtgggaccgcctcccgctcccggagcgcgcgcgcctcaaggcgcgccagggggtcagcgtcctgtccctcgccgacgccgacgtcaagaacgccgacaccatgctcagcgtgccgcgcgacggcaggaccgtcggggagatcgtcctccggggcagcagcgtcatgaagggctacctcaacaacccggaggccaacgagagcgccttcagggccggctggttcctcaccggcgacgtcggcgtcgtgcacccggacggctacatcgagatcaaggaccgctccaaggacgtcatcatcagcggcggggagaacat

SEQ ID NO: 223 - DNA, 662 bp, Zea mays
attatattacctactttaatttcgtgatgatattaacccggattcttttgtttttcagattttcgcactgcacatcaccggaactgtcgatgctgtcctgtcgaaagagcatagacgtgagatatgccgccatatctacaaccatcaggtacctatcacaagcactttttaaatagtattagggctaggacacctacaactcaattaaatctcaattaaatgagaggtatttccaggggtctctagtggacctaagtgaaaaaaaaacaaagaacttgtctatatatacacaacgtactctttatacatattatgttgtgactaaatttatatatatgatctaaactcttagagttgtatcatgcattattttagctatctcttttactttgaaaatccgatctgaaaacttagagttgtacatgctctctctctctacatatatataataaaacgacgctcattgattgattgattgattgattagaacgaggacggcggatggggcttcaatatcatagacgagagcgccatgttttcgacgtgcttaaactacaccagcttgagacttctgggtgaggtgcagcaggaggagaacgatgggctagctaaaggtcgagaatggatcctatcccatggaactgcaactgcagtcacgcaag

SEQ ID NO: 224 - DNA, 621 bp, Zea mays
atgactattgaacagtaatccaatgtttttaaattgtctagttgccttaggggtgataaagtcgactaggatgactagtctatgactagggcaactagtcgcccctagttggcagttagtcgtcctaccttctcggccgatatatatataaggtgcagtgtctaattgcatgttgtatagcactgtagcagtataatagcacacaatttagaatgatggtcaattgctagtgcttgtttaggaattttaatgggtaataaaggtgttattgttggctgtcccactcccaagcttgtggagttgcagcttttgtacctgaaacaaaatgagtaagaagtggcagtgcagcaaccaagcaatgaaggaaaaaaagataatgatatgaccaagcagccaagtaaagatggattaaagcatatgaccaagcaggcaacggccaaataaattggtctacaactccagattacgtaattgaaccatatcaaagtctggaacagcaagagttcaaatgcatctaaatgacaaagagaataggatattcataaatttcagatttgaagcatctactaaacaagtagatcatcatccaattggaagccttctcttccatctctagctgct

SEQ ID NO: 225 - DNA, 697 bp, Zea mays
tcccggtgatccggtagagccaacctgcaggctcgcctccacctccacccgctcgatccctgcatacgcatgcgtgcgtgcgcattgagccatccacgccaggatcaggtgaaaaaaacaacaacaacaccaccgacaacaacaaaggcccagccgcccaggctttgggtaaagaagaaggagctagaattaaaggacgtttagaatccagatccagcagctctctacacagggagggacgatggcagcagcagctgctgctgctgcataccgatcgtactggaagtaatgatcgatctgccggccgggggggccctggcagctggttggccggccggccggaatggacggcggcgggatggggtgggctttgttgaagcctgaaggcgctcatcacggacgtaacgtacgtacctttcactttggacaggcatctgcgtacccgcttctcatgcaacgccaccatctccactttcagctccgtgctctgcgaaacgccaccagcgatcaggaaacgcgcacaggattgggttgttcgttgtcgcaacaatgctgcctttcatgcatctgcatgtgcagtgcagtcccagctagctagtagcttgcgttgcttgcttgctcgcgagagctagttcatcatgcaaagggaaaaggcagcactgcaggtcgactgtagagctcaccagggtaccgagag

SEQ ID NO: 226 - DNA, 582 bp, Zea mays
tagctcactgaagagtgacgatcgagctgttcgcacgcatgcacacatatagcgccatatgcaagcgctgtggtgtcagcagactagcaaattagagaggcttagctaagacacgtgcatgctcattgcacaggtggagtttagctaagaagctgcgtcgtctggagcgtggcgagcaacacgcaccaaacatctgtgtggtggcaactataaactgaaaaatatatatgtgctttgattatattagcaagcgctgctgaagctgaactagctagccaaataaagagttcatcgagcagcagtagtgccaagagagatttgcatgacaaggaaaggcaggtcaagcaagaacacgcgaattaatcccgatggttgatggagactggactggagagcgaggcatgcatgaacctatatctttctatcaatctatcttatcaacaccaccacatgcacccagcagccaaccagctgcttattcttggcaagcagtgcgttaacgttaaaggcatgcatggtatctatagcggcacaaagctaattttgcgttttcttagccttttcgacccgtgcagaagctat

SEQ ID NO: 227 - DNA, 1187 bp, Zea mays
tattatggatgggtgagctcatctataatataaacgtgaactacatattcactgcaaatagaataaaagttatagaactcacctatttaaaagtttcctcataatatttatcttttgtgaatgtgaactactgaacttgggaatcaaataaaaaagcaacattcctttatatgtattcctttgaatttctgattgaatgacattcctataatcttttttctacgtttacatattactggcagtcacctctatgagttagaacaacaccttgaccgcttcctgaagtctgcatcgatggccaaaataccattacctttcaatcgctcaacaattagaagcatacttattcagactgtgagtgcatcaaattgcacccaaggatcactcagatactggttgtctgctggacctggagacttccagttatcttcatctggctgtacaaacccagccctctatgctgttgttattgaaagcccatccttacaagtaccgtcctgctgcagaatcgccatatgcccaactagatcagatagtgggtggccatgcggggtatgctgatacaatcctaagctacaacctaactgcaacaaactgcttcagcaatgccaggagtccaggactgaacagcactgaagcagtcaatctggatcgaattgaacaagtgctggacagtcagtttccacatgaatcagcactgaaacatccggatgagcaaaaggagaagaaggcttgtgtggtcgtgcggaggtaaagctttgacctttgtgcggcttcggcctggttctggtagaacttggcgaagcggccgcggttggctggcttgggtttagagggctttttcgggcgcaggccggcgatctcctgcaccagcggcacgtgcaccagcaccgtcctccacgccacgtaccagcctggggcgacgaagcggatcagggaagggaacccacgcaactattcaactgaggagataaggggaggggagtcatactgaggaggatgagggtgaagacgaaggcgatggcaaggacagggcggatgaggaaaacgacggcgacttccgacgcagccgccaggccgccgctcgccatagcgccggcggcagctcagttccggcctcgcaaggaagggatccgctggcgaggttattgagcctatggcatgcgaggcccgcggaagcaagcaaa

SEQ ID NO: 228 - DNA, 639 bp, Zea mays
aaagagtaatatgatggtgcaatgcagaaacaaggcatgaacaacagaagaatttaaaacaagcaagtcaagaaccaactcatttcttcaggcacataaaccttagcaacttcacaaatcagtataagctcagatcctgaccaccaatgtaccagcggaaacaaaggtcaaacacagaatctaaaatacacctgctagtgtcggcagtacttaatgatcgtgctcaagtactcaacaagcaactatctacaaggaaatgaccaaattataattttccatcgttcagtcacagttaacaagcaccagacactttgtaccctcaaataccaacacgcagaactacagatacaactaccacataaatcgtagacaaattggtagggcagattcaaaattagcaacgtaacaaacacctaacgagacacacttagcgaccagcctgcgtaccgcacggcgacatcccgacgctgaacacagccacaactaccagatcaggcgtcacgagcacggacaagcgaacaggaaccaggcagcatggaaatggaatcacacgagcgcggtcggatcttaccagtccagaggcgctggcggtggagatggtcagcttctggtcgtaagtgtagtccttactgagtagat

SEQ ID NO: 229 - DNA, 577 bp, Zea mays
aaatactggtccttcccctaaaagcatgtcttcctacagtccctggatatttactgttggagcttctgcccatgacagggtatacagtaactatgttgtgcttggcaacaatttgaccattcaaggagttggccttgctcgtaagttcctttgaagtactttttctgtacaaatgtagttacctctatataattgtaacttgtattgattgattctaaatacagctggaacggatggtgatcccatgtataatttagttgctgcaccacatgcactgaagaacaatacagccagttgtaatgaaatgtcccttggggagtgccaagattcgagtcacctagatgcagatttgataagaggaaagatactagtgtgcagctattctataagatttgtgcttggtctttcttctgtgaaacaagctctagatacagccaatgatgtcagcgccgcaggagttatattctatttagacccatttgttcttgggtttcaactgaacccaactccaatgcacatgcctgggcttataataccatcatctgatgactcaaaggtagggcagccaagagctaat

SEQ ID NO: 230 - DNA, 678 bp, Zea mays
cggtacccctggatcgtgctaaactcgacctgcagtttaatgcctttgagctgcaatcccatgcattctaatctgccaccagatgtcagatggtgggttcagtcacagccaaattttgggatccagaaggatattgttagcaagcggttatgttcgttgggcagggacattcatgagaagcaagtggaagattcagtgccacaacctaaacatgaggaaacattactctgtcaagcagttgacaccagcactgaaaagattggagatgctttggagcctccatggatggtttcgccagccttcacgaagtattcccttgaaacaggcttagaagagatgaagactgttggtagctattctcaagtgtcgaagtgcatagaaactctcagcaattgtttgtacaaggataatgaattcccagattttgaatgtattgacccagcacctttgaagaacccagataaggctaattttgacatagatgcaccttggaaaggtgaaaagactagaccatggtggcagattgctgacgaggaccagctggctttactggttgcagaaagagcaacacagcacattgagaattgtgacctaccaaggcctacccagacagtacgcattaacaggacagaaccatatactcacaaacatataggtgactttgggggaccttcatct

SEQ ID NO: 231 - DNA, 624 bp, Zea mays
tccactcaaaatcgccaggttggatttcagtgaccatcatttcttcagtgctcatgtaagtgcagccatctctttttatttttctcaccactgctaaattctgcatgaacaaatcaagacgcctaacaagtcatgaatcagaaaccacaccgatatgcgatacgatacggcgatacgtagtccagcatgtacatgaaacctgtgcactgcctaattctctgcaaaatatatgaaccactactcgcaacaatgcagccagctacttctgttctctgctaaagcaacataatactcgtagtttatgtggttgtgtatttgattaggggtgactattttccattcaccatgtgatggttgccttcctcttattcttgtttacctccaataggacctagagaaaattcaagaaacagcgaggaatctcatggacgagcacagcaaagataccatagtcttagttactgagaaggtagcgccttttgggtccttaatgtctaatcttttgcgtggtcatccattgtaattgtaattccaaactgccctttgtttgggcatgcaggattatgaccgtgatccagaggccctcaagacactggacgcaaacgtttgggtgctgtcttcttc

SEQ ID NO: 232 - DNA, 659 bp, Zea mays
gtgaagagtcatggtcaggccgcgcagcgactgtctctggattggaatccaggtcgcaggaccagacgggacccttgcttgctcgcatcgcatcttgcgtttccggagtcccccgacgacccgacgacccaacgacctctcactttcttctttccttttacgagaagcgaccagcaaggcagcgacctggggttgaccaatagcatgaaggggcgatgggggcggtggcagccttgtcacttggcaggtggcggcagcgacgcggcgtttccttgccggccgcggggctctcgctgcttggatcgctgtgcggtcgtggtggcgcactcggctcggccggctcccccaccccccatgcctgccggccggccggcgagcgacgggtcgtcgcaaagccagcgcgcttttcccacccaaattctcccatccatgcagtacgcgacagagcggctgtgctgagtgctgagtgctgctgcgccgcctctgtttttttccggcagctttgccgtcgaccattccgctttgtgccctcgctctgctgctgcctttcctcagtttctataggaggataccgtaacaagaaaccatacttggcaatatagcttgttttcatctagtggtaaaagtctgaccaattatgcctcgttcgaaaatagcta

SEQ ID NO: 233 - DNA, 630 bp, Zea mays
ttgagatgcttgatgatgaagtctacgttggggcggagaatagctataacctattcacggtgcgcaagaacagcgatgcggcgacagatgacgaaagggccaggcttgaggtggtgggagagtaccaccttggggagtttgtgaacagattccgccacggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttccttgacggtgacctgatcgagtctttccttgaccttagccggagcaagatggaggaggtgtccaaggcgatgggcgtccccgtggaggagctgtccaagagggtggaagagctgacgaggcttcactagtgtagatggaacatggaagcgttgcttgtaagcaagtagtaacttgttccctgagctgtagcctccgcggctcgcacgatcaaagtgttcggccgtggctgcaggtcga

SEQ ID NO: 234 - DNA, 715 bp, Zea mays
tcctctatgggcggcttgtctggctccacgttacgagcaggaaaaccggatgagcaaccgacgattagatagcacatccaacacaacacaatcacacaccagacgactccagaccagactgacagtacatacatctgaggtagaggttgaccgcgtggttgaggaagccgctgccccggacgccggtgagcaggctcgttatgggcacgaacgacatggagatgacgtccgggaagccggtgatggtggagagccacttgccgtggccctgcccgctgtcgacgccgcctctcctgacgtgaatgcacaccatgtcctgcgaggatcccaccacgttctaagggcgttcgttattcacattttcttggtgacgagcagtgcagtagaatcgttggggggcaaaaccgcaacagtacgtgcttgcttacatccttgtgagacacgacgggtgatctgaaggactgccaggcggccgatccgggcccaacgtttagcccctgcgacaacctgccgcctcccgcggtggaagaattggaacttgcggtggaatcctccgagaacctgtcgtcggcgagctccttgagccgggcctgcacgtcgctctgcgtgaggctggagcccttgagctgcttcacgcacaccacgtccttgcctcccatcttcaccccgacgatgacgtgagtcccgtacttgtcgatgaacctgcaggcagcag

SEQ ID NO: 235 - DNA, 999 bp, Zea mays
agagtatatggaatatctttccctgattctcgacgtctcacggtatagaatataatttctgcttatgatgctatattgctatctctgatgacgtggacaactataaactgtttactaatctataaccctgctgaacatgtatgttacatttgcactatagatactagcataaattatttgtcatgattcatgtgttgcacctgactaggcagaaagtttcatacacgatgataatatgatatgacatgcactttcccctgaatcaatgtaatctgttggttaacatgggttatggggataaggatagtttgcacaacacattttgtgaaactgttagtgagcgtgtctcttaggcactgataagttcaggtaaccgtataattatgaattatcaagctaggtcatggatttcagatcagtgttatcgtaatctgtccctgaatgatatgcttacattttcttttgttattgttctcatcttttgcgtctatgtttattacatgatactttgcaggaatataaacattttctagaggaagctaagaaacgtgatcataggatattagggaaatcacaggaactcttctttttccatgaacttaggtaccttagcactcctttatttttcttcatatctccattgcgacatctctggttaatggcgaattgctgattgtacttataaattataattgtgcagccctggaagctgtttcttccttccacatggtgctagaatatataacaaactgatgaactttatgcgaaaacagtacagagatagaggataccaagaggtttacactagttggttatttactcagttggatcagattatagacatttctgatcaattccactgtttatgttccttatatgcctatcttataggtgttgagcccaaatatttacaatatgcaactttgggaaacttctggacatgctgcaaactacaaggagaacatgtttgtttttgaggtatgcacattcacagaatat

SEQ ID NO: 236 - DNA, 1038 bp, Zea mays
aacctgagcatcggcaccagcacgccgtccagcgaccggttgaagaaggcctgggacggcgggaacgagtcgaggatgatggacgacgagtgcggcgtcgagaccttgatgtaccggtccagcgccgcggccaccagcgcgttctggaggtagcgcatggcgggcatgagcagcggcgccgcgctcggctgcgccgagagcacctcggaccccacggcgatggccgtgatgttcacggcggggaagtgcgcggccacgttgcgcgccacccagttggccgccgtcgcgttcgagttgccgatggccagcagctgctcgttgggcacggacacgatgacgcggatgccggtgttggacagcgccgccagcatcgccgggtccgcgtcgtagagacgcacgtggcggatgttctgcgaccggagcagcgtggtgatctgcgtcggcgctggcaccgacgacatggccgtgccaatgttcacgccaatgtacgcacctgtacgcgatgacaacaataacaaataaatgcagagaaccaaagtgtaagaaatctttctttcttgatggaagttacgaacgagtgatagaaatctaacgacggtaacaagagcatcacagttttcctggtaaaaaacgccaaaacttaacagtcagatgtttatatgatcttctgattaatgcgagacaggaaattgcgttgtaaggcagcaatcctcaatataaaaacgcattctttcgagcaaagctgtgtggaagaaaaaataaaataaatcgttcgtacagtctagagtaatgtaagaaaggacgaaatgcatgataccaccatgcgttttcgtagcgaaaacaaacaaacaaacaaaagggaaatcgagctagctgtaaaagcacaagacaggccaacttggtacggggaaagacgttggaaacaggagccccctcaccatgctgctgtcccgggcccggccatccacagaaaatcctgggcaatgtgcagtggccagtgaccacgttgattcctgctgctgttgctgcaggcactgc

SEQ ID NO: 237 - DNA, 949 bp, Zea mays
atagcaacacaatgtgccccctatgcatccaccgggagcacgtgccctagatggcgatatcaaaacaagtataatgacaacaatacactagacttcttgttgatgtctaaggtcgctgtatacaaaggttgcaagctgatgtacaaagggatgagctaacatgtgggcaccatgagaaaatctgaaacaatgcgctactgttgacagtgaaagaacatgtaaccagatatatagtaatgaatcaacaccaattatatttcacaatttgtgactaaagaaaaaaacaatactagcattaattattctcatcttccaaaacataactctggacttatcactagcagtggccattgtgcacttatcattagccaaaaaaaaaagtgcatgcacaatttgaaaaaaaaaacttccgatacaacaaagaatttagccattatcagattcaccttatcatcatagcatagtagtttcaaaatggcaaatatgtagtactactgctccacacccgaattcagtagctgactacatataccaaagctgaaatacttcaaacatagcaaacaagatcagaagacatggcattcatgtacttacggatgcaagaagtgctcaaacagccatgagcgaagaacagacactgcacgctcaggaagccctctttgaggcctccaaatgttgtgaggctggctgaacgcgttcacgctgtttcccctcaggaggcctgctccaccacccatgagcgcgaagttcgccatatcgtccttggcaataatcccatggttggcgatgaccttgctcgtgttccgtagctggctcatcaccatccccttcagacacttgaagtgcttcgacatcgtccgaagagccatgaaagcgaagggggccgcgttgctcagccctgcaacagtctcgaacgaggagatcacggattgcagctgctggtagtact

SEQ ID NO: 238 - DNA, 893 bp, Zea mays
ttctcctgggatagatgctgcatttctgtgtgcacgtgctgacctaggccttgttggggttctcgtgaagttacaatagtcaatcaaactctccttaccaacgtgcatctcaacttccatatttgtcacctcaccatcacaagtgttgtgatccaaagtagcctcatccataacttttttgtcatcttcagcttcctcgtcaggaatctcatcttgaatcttaccatctgataactggttgggatttgactctgtaataacataacaagaagcatgatttacatcggtatctatcccttgcttcactacctcagtttctgaattctgcgtctccctgtcatcctccacctcgccttcctcagtctcctccggcacctttggcgcatcattagaatccttaatagtatctttgaaagagctcataatctttgacgttgcatcctccatgcagaacccttctacagccttcgctgtcaatggtgtcccttccctcagtgcctctgtatcatgaggcctcacctcatcactcccccgattgccgtgtcgctctcgctccctccgaaacccaggtgccccatcttcatccttatcctcctcgtagcgccggccatttggaaatggccttctcctctccttctccctgtccctccctgaatccaaataccccctcctgtatttcccatacttcatcttccctcttccattgtagctgccacggctgcaatcatctctgctactggtgctactactagtgtcattggctcgcctaggattattgttgtattcatctttgtaccgcctccggccataacccccccggggttcctgctgttgcagctgcggtggcggaggaagaggatgatcaggccacgcgccagagatgccggcgccgc

SEQ ID NO: 239 - DNA, 894 bp, Zea mays
agttgctatgataaaggccggccagtatatggcagctgcaatgaccaaacgtgtatcactatcaccaccaaatcagaacacagcactactacacacaacacagtgacaatacgcactatcaaaataatgcttgatgcaatatgctgccagtgttttgcacctagcagacactagtgtggtggcacactgacagctgtgcctttaaagtagtggcgaataggactgtgtgatgtcgtagatgagatgggggggggacctggaattgatcggtagaaggcgtcagccacatgtgttttgttggaaattatgtaggcggcctgccctgtgtacgccagtagaaggcatggaaacacaatcaaggtgaaagcgatctgcaaacagatcttcactttagcagctacataaatacacatatggctactcgataccgaaggcattttacctgaattgccagcacaggaaagtgacagagatcagcaaacaatgcttcagttcctgcacagggggaaaaaatgtttttttcatgctacaattgatatactagaggcgatgaaacataagcaagcttccctatttcttaacccccacccccatcccgcgaaaaaaaaggcaaagtgatccgactctgacccgtgatgctaagcatgattcctcccagagacgtccagacgtcagaattctttctccgtcggaaaaaacggtatatatacatcgggttgtatgcttttagcacagagctatcatacttgtgtatgtttatagccccgacgcttccaatcaggatgaaccagaggaggactattggcgcgaagagccatcccactttgtctgttccgtagtgctgcatgctaaacaatccgattaagatgaccacagcgacgagcacaacgacat

SEQ ID NO: 240 - DNA, 895 bp, Zea mays
atcttagcaaatccttaaaaaaaatggagccagcagaagattgctaatattaggacccagcttgtagttgacaaggagatacgtccatctggaaattgctagggactcgcgagaccttgctcatagtgaagaatggctgagaaggaactgcactgtcttggtttggcctctctggactgtgccattgctaggctgcgacctagagtgttatgtatatgagaaggtggtgccaatactaccttctgccacttgcacgcccgctgccaaaagaaaaaactccaagttgaggatcatatctttacctggcaggaggataagcgggaagctgcccttgatttttatgaaaacctgctcgggtcgactgaagcaaggaacttcacctttgatcttttgactctccagattcagcagcacgacctcgcttccggcttccttagatgagactttctcagaagacgaggtatgggcaacaattagagatatgcccttagacaaggccccaggattcgatggattcactggttgtttttacaattcttgttggcatatcatcaaagaggatgtgttcttgtctctctcagctattcagaatgtccatgttttagattttgtctgctcatctgctgaatgctgtttttatcactcttcttccaaaaaaggtgggtgttattcaattgaaggaattttggccaatcagccttatacatagttttgccaaattgggtactatggtcatggccagttacttggcacccttgctgcccagcatggtgtccattaaccagagtgatttttcttcttgtccagcagatggctagttgtttatacaggatgaaataaccccacattctcctcaagcttgatttttcgaaggccttaaactcggtttcttggt

SEQ ID NO: 241 - DNA, 921 bp, Zea mays
tgcatgcctgcagcacaaaatgaacaatgcaggcactactaaaaaatcgatgaaaacccccaactacaaatgtttgcacctgagccagctgcgacgttgcgtcgttgcctgtcatcgaaaaagaaatactagccaatatacatgtgcgaggtgaatcacaagttcataacacatgaccgcgagaaccgcacatggcatgcaagctaaaaaactgttcggtttcacctgtttaggattctgaccgcagcaagcacacggagatggttctcgcgaatcccctacgcaactaaggtcgcaatcatgaatcatggtacacatgaccgcgaatcgaccaccacaaaccagcgcatgcaacaggaactaccaatcgcggcttgttacctacagaagcatcaacgaatctaccgaggacgaggaatccaaacctaaacatcaagaccaacatgcaacccttcctgaggtaaatctaccagacgcgaaggctgccgagaacctcgatctaccgcaacggatcacgccagatcggatcaaggccagatcgcaagaggggagaccttctcggggtcaccgcccttgtcggggtggttcttgatagcagccttgcggtaggccttcttgagatcgtcctgggacgccgacttgggcaccccgaggatctcgtagtacttggtgttgtcgctcttcttcggcgcgcgcccgaacatcttgcctttgcctccggcggtgccgccgccgctcgccgatgtggggtacgacctcgccgccgccgccgccgccgccgctcctgcgggggagtggggtggggaggagcagtagcggaggggaagggaggcggcggtcaaagctggtggcccagcggagttagaagcgaagagggtttgccactggcgatacgcgttggctaatgtagtccggcctgta

SEQ ID NO: 242 - DNA, 1023 bp, Zea mays
agaaagaaatttggttaataagtgctcatcaattgataatatatataaaaagcacattctttgttacttcttcaactagataaatgaagcctaaatgtttgccaatgtaacaagtaacaagaattagtgtaaagcaaatgcattctagatttcatgtctagcggtccatgtatatttgataaagagacaagctcacagaaaaatatacaagggtaactaaatatgttgctttatccagataataccatacatgcagaaattttttacagcatgggacctcaatttaaatacagaaacatagcagtgaatctcagtcgacgtaaatggcaagttgcaaagtgactaagtgagccagtgatttgatcagacatttgctagcatctagcgccacaactaaagttgcgacaatgactcggataaggcatgaaaatataaagcctatggggtgtaatcaattaatcatgctcatatccatcgaactgcacaaaaccaacggtccaacgccactgcctaactcagctatctgacacctcccagtttgtcacacgatgtaatgaggaaattaagaaaatttcaatgcgagaacaaatgatttagacattagactaattccccaagagaaagaacacttctgctcacaaacaaacccacaaggacacaacgcagtccaaaagcagatgaaactcggaagagtaactaaattcaggaacatgcacagacccaatctacagctggaactaattcctacaattccaccaatgtgaacccttagaatcgcaacaatgcagaatgcacacatccctctctcaggagggtaacttgccaacactcagttagtcaagctccaaccaaagcccaaaactctgcctcaaaaatcaagcaaacgcaagcatgccaagcatcacacctccaccagtcaacaggggagataacaaacatggagagggaaaggtgtgtaaccttgccgcctccaagtcagccggctggcctgaaaccctaggcaaccaagcaccagcgccacca

SEQ ID NO: 243 - DNA, 961 bp, Zea mays
accaacaacttcaacgagagcaacaagctcggggagggcggattcggcaccgtctactggggccgcacctccaagggcgtcgaggtgcatgcatgcactacatatctgttcatggtcttgtcagtttaattacatgtcgtaagctcgtgattaagattcgtgacaaatgtgtgcggtacggtgttcagatcgcggtgaaacgactgaaggcgatgacggccaaggcggagatggagttcgccatcgaggtggagatcctcggccgcgtccggcacaagaaccttctcagcctccgcggcttctacgccggcggcgacgagcgcctcatcgtctatgactacatgcccaaccacagcctgctcacgcatctccacacccagcgcggcgccccctcctcccagcagcatcagcccctcgactgggcacgccgcgttgccatagccatcggtgccgccgagggcctcgcgtgagtcatcatgcatgcgcgcgcacacacaccgacaccgtgcaagtgcaatcaaagactttccttaagaatccgtgtcttcgttcatttcagctacctgcaccacgaggccaacccgcacatcatacaccgggacatcaaggcgagcaacgtgctgctggacgcggagttcgtccccaaggtcgccgacttcgggttcgccaagctcatacccgacggcgtgtcgcacctgacgacgcgggtgaagggcacgctgggctacctggcgccggagtacgccatgtgggggaaggtctccgagagctgcgacgtctacagcttcggcgtgctcctcctggagctcgtcagcgcgcgccgcccgctcgagaagctccccggcggcgtcaagcgcgagatcgtgcagtgggcggcgccgctggtggaccgccgcaagtgggagcgccttgcggacccgcgccttgccggacgcttcgacttgctgcaggcatgcaagat

SEQ ID NO: 244 - DNA, 912 bp, Zea mays
cgaaagccaacaaattatatctggtgtttactgcaaccaagtgacgaatatcattcagtttctcaaaaaggggcgtacccagtgacgtaggcttcccgcactgtgcgggggtctaggaaagggtatctttaagcaccaagccttacccgcataatatgcagaggctagggctcgaacccgggaccttccggttacagacggtaggctctaccgctgcaccaggcccgcccttttgctgataatttatatgtatcgattgccgtctttcttatgcatctatggatctaaccttcaatgtgccttacctttcatgctgccctaatttccatggtttgttcatagaaataagaagcaccaactaacatagttcagtaagttctattaaactagccaatttcccttttagtttataagaccaggagaggtaaatgttgtggaaagaatgacaattatacttaccatctaggatactgtggtagcgaagaaggttcgtgataatggaaccaggatgaagagaatttgcagttatgttgacattatcttcctgttagacaaaatattgtatcatagatagagagaaatagttatagaacaccttaaaaaactggaaactgaatggtaactgtaaagagaacatataatcagcaaaatctgaaacattataatttttgtgattggatgatgagtgttccttgaatttgttacaccaagattagcaataaatgcactcaaacttccatgtccaagttggaacaactcactgtcactgcccaatgatctttatttaccaaaagctacaatttttaaaattcagatgcaaacatctttaaaaaataatgcaagtgatgttggtcacaaacagttgcaatgcataccaaggaccctgacatgcttgccgaacaatccagagct

SEQ ID NO: 245 - DNA, 999 bp, Zea mays
tgcatgcctgcagacggggccctgctgccactgtgatctcgtgagctaacctgtgtgactgtgcgtttcttccttcctcctaccctcccctcccgtcctcacctcagactagctcggaatcctccgtcgccgagcaaaggttccaccaaaagaccaaaccccaagtcctcgcaggatttgattctctgaccgattcagggacaccttcctcagagcaatacttaccagcgtgggcgtggctaccaaccgcatagtttccatgagcagatgcaaaccagtcggcggcgagagcccagcagcagacggacctgacccgcggcggccgatgtcggagacgccgtgttccgtgcagcccggggtcctccctctcctcgggaagccatacttcacatgcattctctgcaagtctcatgtcaaccagccgttccaagtggtactgctgctactcatgctctctgcttgcatctgctgaaacacttgtctcctgctcccgctcgctgctggggggcgcaggctaaagccgtgcatttcgtagtgtaatgatcgaagtcctttggtgcctggctctggctggctgcatctgcatgcaggtggtccccaagtcgctggcgccgttcctcccggggacgacggtgccggcgacggtgacgtggcacgggcggtcctgggagatgcggttcacgggggggcggcagatccagcgcctggaggccgggtggcggggcttcgcgctggacaacggactgaagctcggcgacgggtgcgtcttcgaggtggtggacggcagggcggagcgcgtggtgttcagggtgcaggtgctccgcgccgacatccccgcggagatccgggagcgggccggcgggtacactccgtccagccccatcctcatcgactagctagctcattgctcacctcatctcatcagctgctggtctgtatccccccgtgcggccgtctgccactgtcactgcgccggcctgaaactgaactgattcagct

SEQ ID NO: 246 - DNA, 912 bp, Zea mays
agaagtgcagaactccagcaccaacggctgctcacctgcaccccctgctgtcctgctccattcaacggcgcctgcgcccctctgcctgcttggctgctcgcctgctccagtccagatatcagcggctactccagcaccattgacttgatgagctcgtcatctcaaggttcctcctgctccccccccccccctctcccggatggttgctgtcgtaatcctaagccagtgatgactgatgagtagtgacttgtacttatgtctctgtttgcaaactgctattttgtttatgtagctgtttgttctaatttatataatgtatataggtatatttatatatgtatatacctatataagtgtaactacaagtctaaaaggtctaggacgactaggggtcaactagtcgccttggtcgtcgcctaatcgcaattagtcacctagtcaatcctggggagcaaccaggcgacttgcaatcattggattggatgccactgtagagcatctgatttgatcctactattggtgactggattttaaaagatggaaattgagggtccatggatctacaaaacacaaatcttgcagtaccaaagtaataatgcagataacacacaacattcaaatagcagcaaatgcaaatttacatgtttactgtcagaaatatatgaggtttcctatcagcaaagatcaagtaacacacaaacatcatcaagtcaatagcaatgaacagaagacgttaaataaagcggtaagaagataaactaagattagctaactggaaccagcaagattttgaaatatgagacttacagacagcaatgcaccagcctgttcaacaataatttgcctagtagagtgcatattttcagctagcaatgatgcattatgaagcccaagcacagaagctgattcagg

SEQ ID NO: 247 - DNA, 923 bp, Zea mays
agcttgcatgcctgcagcagtacgcggccgcgccagaatctgtcccgccagtgccaacccacacagtggtctactggatgtttggcaactcgtcctgtgcagaagctcggagctccaatgcctctggctgcctcagtgacgagagtgagtgccacgatgagcctccgcgagggtatagatgccagtgtggccaaggctatgttgggaacccctacatgccgaacggttgccaaggtacgcatcttccggttcaggttcaacttgtaccatgtgattactttgcactaattagtaataacttgtttttactcatggtaatagatgttaatgagtgcacacagacagatccaccgccatgctttgggcaatgcataaatacaataggatcatatgattgcatctgcccatctggcacctcgggcaaccccagagtaaaagatgggtgtagtccaagcaaattgaaattatcaggtaacaataaaaaaatcatgatatctcttgtttatattctaaggaactaagcctagcttagtttgccatgagggtggatgtacaccaatatcgcccaaactcaagttctcatcgagacgaattcgggtgcctatttcttcttaattaagtcacctagttcctcctacattggtcgattattttaccaacactcttgtagtgtagcgatggactttcctttcttattttttattaatataatgaggggtacatctcctagcgtttccataaaagaaaaggttcgtcgaagtaaataatctgaattccattttttcacaaattacccaggattgatcattgcaatcggacttggaagtggtattgccattctgctgtttgttttcgccattgtcgtcataaggagaaaggtcaaggctcggaaagctagaataacgaaagagtttttcttcaag

SEQ ID NO: 248 - DNA, 958 bp, Zea mays
catcttgcatgcctgcagtttctttggtagacataggtgggcatgaaggtggttagttctttaagatttaagatgctaatctttatgttgagttatactgtgattaaaatgaagataaacatatagtagtgtggtctgtggtgtcaggatttgttttcataaaaattctttctgcatgcttaggtctgtttgttaaggtatatgctagtgtaaaagatggtgctctcagacatatccatgattcaaaattaaattagtggttgtgacgaagaattttgagctgggaaggcagtgtccacaggcaattgcttagagccctgccctgctgtgtatccttaaaattgacatgaatttaggacccttgtgatttatacatctatgccaaattgccaagtgctacttttctctatgtggaaggagatacatgcatggaaagttttgcgcgagccttgagtgtatcacagactatcacagctgagagggatatctgaaggatatatcatgattcatgattaagttaatgtgaagatctgactaaaattgtgcttgcagtaaacaaaacagttctggttgggaaccacagatctcttaggaacattgtattctgatctgactaaaattgtgcttgaaatgaacaaaacagttattggcaacctcagatgcttagatatattaggaacaaatgtattccgatctgactaaaaccgtgcttgcagtgagcaaaacagttcttgttgggaacctcagatctcttaggaacaaatgtgatctgatctgactaatattgtgcttgtagtgataaaaaagctcttgttgggaacatcagatatcttaatttttttgaaaaacgcaggagagctgcgcatatttatagataagatagaagaaagggtcttacaagagaggtacaggttagggacacctgcacccacacacacgcactatcaactgaaacaaa

SEQ ID NO: 249 - DNA, 917 bp, Zea mays
ccaggaatgccatgacacgcaactggtgacagcaaccgatggtggatggatggacatgccgtcgacctttccgctaattaccaacctgtcctctaagcaactggtgacagcgagcaatccagaacggatagagtataccacttcacttgctttgttttagcacgtagtagtatttttttcccctatatctcgttgtgtatgtatgatgatgacgagtggatctttagctggtgtctggctggctggttgcggcacagcgaatggatgtcgtgcaggatcggagccaccggacccctttgtttatcgttgctgctatgctcattgctccgcattgtttagtacgcgtcggcacgaagcttgccgcggcgcgacacgcgcaaaaggtaaattaatctcgcggcgaggcaaaatcgctttgcccggagccccccccccgacgggcgacggcgccgggagggaggacggacgtgaactgctgctcctcccggtggctggctggcatggcaggcgcgacgccattacttggtcttgtacacatcatgtccgtagtcgagctgtcgatcttacttgcaataccatgctgggcctacggtgcggtgtggtgcagctaagcttaggggatcgttagtggattctcgagtgctgcgtatcacggcgaacaacatgtgatgcgatcagaccagagtttcgtacgtcgtgtggtgtcagtacatggaggatggaatcacggaaatggctgtactatatatcctcagaatctgcgttttttgttacaccattgtcttatgtatacagcggccgggcctacggggttcactttgcgctctgttgaaaaattctgcctcgaccacaactccagatgcagactggccattagcgtgcgtgctggattcttctgatcagcacatcgagagcat

SEQ ID NO: 250 - DNA, 932 bp, Zea mays
gcatgcctgcagctgagacaatggtctggaccgttgcataaagataatctacgcctagcgcacaattaactgctccggctgatcaaaacctgtacatatgcaatccaataggagtaataaacctaccgatcaccagaccgtcattctgccatcagttgcttactgatcgtgtactatgccagatcagctgctttgttttggtctcctgccatcctcgtgcgtcgcgcgcgcggccttcctctacctttttttttcttcttttttttttcttttccttggaaatgtgaaacccggccggccttcgcagccccttcgtttccacaccactttactccttaaccctaggtcgcgccagccatggcaatcagctaactagagtgtccattcaaagcaaaaccacacggtactaatagtaatcaaccgcacgccccctcgcgcgcgcccacacagtccacgtacgtgatatacacagcagcagcagcagcagcagctagacggccatctgatcaaccttctcgagctcttctcacatctcccgctcatttttaccacaagctagccaagagggctcgctcgctagcttagctatatccggccgccgacattatactgacgatggcccacgccgccgcggcagcgctcgcccttctcgtcttcttctgcgcgcaagcgcgggacgcggccgtccatgtcgtcgacgcggcggcgacgctgtcgcaggggcagtcgctgggcgccaccgacaagctggtgtcggccggaggcaccttcgagctggccttcttcacgccgacggggggcgacccgtcgcggcggtacctgggcgtcatgtacgcgcagtccaccgagcagaccgtgccgtgggtggccaaccgcgacgcgcccgtcagcgcggcctccgcgtactcggcgaccgtcacggccgccgggga

SEQ ID NO: 251 - DNA, 983 bp, Zea mays
agcttgcatgcctgcagtccaagcaagcagaaggtcaaaacacaagttcatgactgagtcgatttcaaacaccactgcaacaaatgaacatcttagacacttggctatggaccgtaggtctacaagagatgaatgcatgaatgccatatcaaatcaactaaaaggtagatgtaattactgattataccgtaccgtttgtggtattcagttttcatgatatatttcttttttccaatccacgtgtttggatacttgcatattcttcaacactgtatgtcgcagtgtgattgttagacaattagcagtggtttatgcagattctcaaattacaaaagcgcagtttgaagggttttgttgacctcttagatccgaatgaaatcattactgatgcttctaaaaaaatctaggtttagtttgatgtatatacatacactatatctctgttactgtgaacttaattcttttttcctaaaatttttcctggaatgcgcataatctcgaacttatgtgccttagtaaatcttaatttgatggcagatattgaatcccttgaagctgaaagtgacgcaaatggagataagagcctagagacggctcttatgtggtatgataagtttcttggttttcaagttgttggaggagaaggtaatggaaatcttagtgacatggttaattagtatgttaggttgatgcgatagcatgtgacacagtttttttttgtttttgttttttgcaaggggtgaaatttgtgttcaacaaaattgatgtgcaaaatcctgacaagaagtattctttttgcataaaacttgctggagaaagatacatctgtgagttacaagtttcttagctgagccatctgatacttgtagtagacgtcacatgattacatttgtgcatcgacgttgaagttccttttcttgtcgataacagtagtctggtgtgttccatctgtggacgatgctgaagaattggtgaaggatctt

SEQ ID NO: 252 - DNA, 1660 bp, Zea mays
atcagcgtcggtatctgcccgttgttggcgaagtcgatcttgttcagcctcatgcagcacaggacatgctctggcaactcctcagccttatgtgcctgtaaccagtatcagaccatgggttaagctacagacactcggtcaaggggtcacttttcttttttttttcctttttttttctttttcttgaaacaaatcaagcggtcacttttcagccagcagccgaagaaaactgtgtgtacctggatagttagaccaagatcaagaacgccatgcttcagccgctcctggaatgtctcgagccctttccgtgatatgaagctgaaccgatggacatccagatcgatctcaaagtagtttgaaccctacattattatcaatgcaaaagacacgcattttttttatgtttgtcagagttggaaacacggttcactatttcagcacctgtttgtctataaataaactagcgaggaaattaatgcagtcgtcggttaccttgtagaatttgtgttgtgggcgagatagcacaggcttcatattgtaggtctgcacaagcttcctctctgctgtgctcagttgcaggtcctcagggttcgccaaaccagccaggattttcagcctctcggtgtagggcacaatgctgtctactgggaaccccttcaccttttccgtttcctcgttcatgagcctctgcatcactggtccgtcagaaagttttcctaatgaggtgctttgtctgtgtactcagataaatctacctttatgctgtcctgcaactgaggagaaatctccttgtcaaaactgtcagataacttgaaatacagaactaggcttatcccatcgccgtcgttatcgccaaacactgtagcagggtaggtgggcaactgcacaaacaagtaaaaacttgtcaggctagaagccagaaattaacaattaacagtcagtaattaaagagcggttgttaagaaccgtttatagcctactgaattacctgaatgttcacaatgaggagggtaggaaaggcttcgtgtgtcttgagagacggaagcgagaggtgctgcccaatgtgatgaatctttctcgtgtaggcgaacatgtctgctccaatgggggtgtaagggtagcagtctggggccgggtatttcctcttgtctctgcatgaatttcacagttcagtcaggcataatcatgtatacaatatcgtcagaattgtgttcacaatactgccactgtacgtacttgaagaagctctcccctcggaccttgaacgtcgatggctcaagaaccgaccagcaaccttccgacagcttctcgcccgtcgaacaacacggcaccgtgaaacctgcccttgggcggtacaagtaattcgcagaaccacttgggatagcgctccctgtaagcgaagtaataatccagccactgaacggcactgcaatggcgtagctcatatgttaacgctaaagcaactcactcgtttcggtcatctcgtcgccctcgtatgaccttgtcctgaacgagagcctgaccacgaccgttttcttcttctgctgctgctggtgcgggctggcaccagcgatcggcatcggctggaccttgttgctcggaatcgacgccgggaacggccgcggcgacattgcggcctgaagctcctacagtgcggcgg

SEQ ID NO: 253 - DNA, 967 bp, Zea mays
tttgcatgcctgcagatatttgatagcagctggataaaattttctccgtagcatgactgctccaagctcaaaatactcagtagcacttgcatcaccgcttctcacttgttcctagcaaataataaaaattgtcaaaatacaggtcaacatatgtaaattggtatataaatccaattgtgctgtcagaatcatcactacaggcacttctgccagaacgagtactgaacgtttgttagtatgaaacgataatacaaggcaactaactgtttgctcagacaagaaactagaagttgcaaaacctgactgcgacaattgtatgtatattagagtccagagatatttatgggaagaaaagcagggagaagacgtaccccctgctttaatttgtcttaagagagctactctttagagcatctccaacaaggtgtctcaaaacagtgccccaaaaactaaaatactacacagtgtttacaagtcgtccgactaatcgtgattagtcaggctggtcgcctggaagagggcgattaggaggacgacacgattaggatttcaagtcgtccaactagtcgtcgacctggacgattagtcgtccggttgaaagcgtcctggtcgtttcttgtcgtcacaattttggtactgggcttaactctaatttttggcccatctacagtagtacagtaccatatatgttgccctgcccctccggtagtaaaccagccaccagcagtaaaccctcccagccgccagcagtaaaccctcccagccgccagcagtaaaccctactcctctgtcctctctgccgacgtccagctccaggcctccagccaccggcgtccagtgctccattcaccggcggatgctcctgctccaagtgctccggcgtctgccaccggcgtcaagtgctccagcgtctatcaccgagtcaagaattcaagatgagctcgtcatctgaaggtagcaccgagct

SEQ ID NO: 254 - DNA, 483 bp, Zea mays
tgctgtagttgatctggcagccctgctgcgcgccgcagtagtcgccgaacctggacagcgccgtggacaggcactgcgcgcaggtcagcggcgcgaggtcccgcgtgcactgcgccagcccgtagatggacacgaacggcgtgtactgctccttgtcccgcccgagccccgcgctgcccgccgccgacgcctgcgccgtcgccttgcccatcaccttccccaccgccttctcgaacgccttcgggttgtccatggcctgcacgttcaccaggatcacgcccgcgtccgtgtccgcctgcccgaagaagttggcgttctcgtaccgcatgaagcagtagtcgtacctgcatgcatatgtatgtatgcaagctcgatgcttagcattagcagttgcatacttgcatgcatgtgtctacataattgcatacgtatctatacagccatgcagtgttgagcataccatatcctcgcgtcggaactgta

SEQ ID NO: 255 - DNA, 539 bp, Zea mays
aactcaggatgttccaaggtctgtgatttgtaatgttcatggagttaaccccaaatttattgagattggcaaattgaaacatcagcagctatgccaaagagagcaagcattcttcaagggtgcatattatatcggaaagatggtatggagtaaaggttacacagagcttcttcagcttcttcataagcaccaaatggaattgtctggccttaaaatggagttgtatggcagtggggaagatgctgatgaagtaaaggcatcagctgagcgactgagcttagatattagagtctatccaggccgtgatcatggagattcaatatttcacgagtgagtatttaatagatgaacaataactttttatacattcttactagctgctagattgttttatgttcaggtataatttatgataagttctttgtaccatcactttataatctttgagtctcgactgaactgtgttattgattccattgtctgtcccagctacaaggtcttcataaacccaagtacaactgatgtggtatgcacaacaa

SEQ ID NO: 256 - DNA, 526 bp, Zea mays
tactcacaccattatgtccagtggtgtcttcattcagctttgctgttttagtactgtgatcgccatggaacaggccaccttttctcaaccttttcaaagcaggagagccaaaaaaatcatcctcaactgtgttaccatcttcagcatcataattatcatcatcactatcctcattatacttaacttcttgcttctgcctgctagatctgcgagtttgttgacctggccctgccctattttcagaaggaccatgttttagaatctcttcctcactgtcgctactggtttctgatatgctagattcactggattcaaatgctgccctcctgccccttttcaatccagcacttgatgaagcttttgaaggtttcctggtggactgtgcagatttcattttgtttttcagtccacctgcgttaccatcagctttccgctttgtattcacattagcatgatgagaactggtattaacatgaactcctgaagtggcagaccagcctttctgaccagtgacatttgattgatg

SEQ ID NO: 257 - DNA, 515 bp, Zea mays
tggccaagctactccacacacgcggattccacgtcaccttcgtcaacaacgagttcaaccaccgtcgccacctgcgcgcgcgggggccgggcgcgctccacggcgccccggggttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagcttcggcctccgcgccgcgcgggagctcggtctccgctgcgccacgttctggaccgccagcgcctgcggcttcattggctactactactaccgccacctcgtcgcacggggtatcgtcccgcttaagaatgaagcgcagctcaccgacgggtacctggacaccgtcgtcgactggatcccttgcgcgcccaaggacctgcaggcatgc

SEQ ID NO: 258 - DNA, 494 bp, Zea mays
cctgatctcacaaacagatcaacacaggtaggttgtatgtggaccttggacaagaaacgacctaccttttttttcttccttcttcccggcccgttgcaagcttgctttcacatctcctccggtcctcctccatgtgtacaccaaacaaaccaagaagaaaaaaatgcatggttttgttcccgatttataccttggagcaacccttccattctcttgaaattttctttgtcgccccttgaactttcttcccatatgtccagtccagctacaaattaatggcgacgagcgatgaaacgcacggaacatatatgcctcagcaggcaaacgtcccagtcgtcgatctctggcacttaattaattgtttatattaattccaactcgttcgtgcaacggtgcaaacaaaacaagctgacgatgtcgagtcgctgtttccccttccaccttaattgcttttgcagccaaacctcctgctggacaaccagcagctccagcta

SEQ ID NO: 259 - DNA, 527 bp, Zea mays
tacacggctatttctacatgccacatgtgcatatatatagtaagcatatatgaaggatcacgtctcaattctcatatgtcatctatgtacataatatacatactattaatatgttttttaaacaaacttaacctgcggctagctagctagaacctcccacgcaagttgataaaatctttcttagacctcaccatccatatatatagctagcatgcagatgcaacatcactcctcaattcacataagtcatcaaccttctcatcaggtagactgagaaaacccttcttaaacatcgacaaaaccatactttttagagacctgtgcttcggcggagtcgaacttagaacataagaaataagaaatgctattcggaccatctaactaactcagcacatgtatattattaataagtctaaccttcgtgtggcacaaagaagccaagcagcacagtgagtcagttgggtataaacttgaagcgaggcttggaaaacgccggagccggatcgtagcgcccataatcatttgtc

SEQ ID NO: 260 - DNA, 474 bp, Zea mays
atgtcggtggagtttcaggtgccttccccactggtgccgaccagggaaagctacttcgtgaggtactgcaagcagaacgccgacggaacatgggccgtcgtcgacgtctcgctggacggcctgcgccccggcgcagtcctcaagtgccggcgccggccgtcgggatgcctgatccaggaaatgcccaatggctactcgaaggtgacctgggtggagcacgtcgaggtggacgacaggtcggtgcacagcatctacaagctgctggtgagctcggggctggccttcggtgcacgccgatgggttgggacgctggaccgccagtgcgagcgccttgccagtgtcatggccagcaacatcccgaccagcgacatcggtggtgagatttctgagacctgcactgcacaccatatatatatacatgatccaaaactagttcagatccttgacggccgggggaacgaatcgtttgcttgc

SEQ ID NO: 261 - DNA, 478 bp, Zea mays
tcaaggcattttaataagtgcatgatcaatcataaactcaccaacttccaaggtttccacatcaaacacctctgaatccacgcttccctgcacgtcttctggaaataattgacgagcaatcactctctttcgagatccggcccatccgggactctcacttgtttgtggtaatgcagcacttttggttggatgcccctttgatgggaaacccaataacaggtcctcgaaaggatagcgaacagcagcagacgaatgaccacattttttgcaggacagtgtccgagccatctcaaacctaaaaatcgaatccatcattgtaggtgcatcactttgcttgttattattcttgtcgctttcattccaaatagcgcgcaaggccgtaagcaagtcgtggctgtcttccatagttccaatttgaaatcccgaaggatcacgcagatttaaacaattcaaaagtttaatcggattaaggacgcct

SEQ ID NO: 262 - DNA, 540 bp, Zea mays
atttggtacggattacggcccccccgttctcgaactccttcctctacgtgctcccatggctcctcgtccttacagaaatccccgattaggccagtgatgaagcgacgggaaaatcgtttcttttttcttgatttctcgccaaatcttagttattaagctccctttcctcttttcttcttttgctatttatttccccatcaagaaagcactaccatacaagctaccctccagtgcttggcaactgttcatgtctccttcactgctcttcccttactgcaaatcctttgcgagagctgcatgatccgtgtaggcttccccttaatctgctccaaagactcgctcgctcgtccaccttcttgccccgggatgatatttcatgtgctctgtgctacttcgagagcagccccctccgcgtgtctcctctcctctctggcatccatacctcacttgctgcatctatcagcataaaatcatgccattggattcccaaagaacagctggtttggttggacatgaaataatatgtgccttgctttctct

SEQ ID NO: 263 - DNA, 477 bp, Zea mays
atcagacggaagggaaaaacttgttgaggttgaagggcagcgagtagaactcctcgctgcggctgtccgtcttgaagctccggaacttgtcccaccagtggtagcccctgtccctcctcacgccgctgtcacgcacctggatcgtgttgtccagtaagaaggccaccagcacagccacgaacggcttcgacgagaagggcacgttgatcatgtcgttgaactgccgacatccaaagccaatgatgagtgaacagccgttacaagtctcatttgcagtgcagaagaatgacatgcagagctagctccaattcacgtacccatcgggcgccggtgtgcacggggccatagccagccacggacgtgtactcgttgaagtattggggtactgacaggcccatgaacaaggagaaccccatgatgaacttggtcctgaagctgttcaggttgcagaactgaaggaagctcaggccacaagca

SEQ ID NO: 264 - DNA, 530 bp, Zea mays
ttcttctcccgcaaggtcttcttgtgttcaagcttgtcctccttgtcgtgtttctgcatttctctcaacatctctgcataccgctgggaaactggagcaagagacaataaggaagttcaaatttagggttcacatccttcacgcaaattattgacgacaaagaaacagagacagaacagacttttatccttgtgaaccacaggttctaaagatacttcttcagcgacagatgcaagaggtgggatggcgttgccctcatcatcatacttgacccttgttcctgatggcctgttcacgtttatcttcagtttcttctttttgaagggtctttcaagtctgacaaagacaactggttagcataacttcggcaaacaaaacctggaactaaatattcggtagcatcaaatttcaaaggtagaaatgtcttagtttgaaaattgagttgcatggtacatacccagtcacatttgtatctgtggcagactccttgggatgaaggacatcatcaagtctgtcatccatattagcat

SEQ ID NO: 265 - DNA, 507 bp, Zea mays
cgctgaaccttagctccaaccacttcaccgggccgctgccccgcgagctcgggcggctcgataagctcgtcgtgttggacttgtcgcgcaacgagatatccggccagatcccaggcgacatgagagggatgctgagcttgatcgaggtcaatctgtcgaacaaccggctcgcgggcgccataccggtgttcgggccgttccagaagagcgcggcctccagcttctccggcaatgccgagctgtgcggcgacccgctgaccgtagactgtggatcatcaatctatggctccagctatggaacggagacggaccacaggggaatatcttacagggtggccttggcagtcgttggttcctgcgtgctcatcttctcgctggtgtcgttgctggtggcgttgttcatgtggcgcgagaggcaggagaaggaggaggaggaggcgaagaagaaggcggcggaggtggcggtggcggcagcagccccacaggtggtggcctcggccgtgttcg

SEQ ID NO: 266 - DNA, 616 bp, Zea mays
tgcctgcagatatagcatctttgttctggttctagggttctttcggtttgtctccacgctttgcgccaacctttctcttctttcttgctatagtacgtagtagtacacaccgcaccacgaaagaaaaaaagacagtttggcactgccgctgtgttttgtcttatatgattcagactttcagcgatcagtacgaacagccttttcagggacagcgtttaggtccctaataatttcagcgctctaataatcatggctgctagcgacattttgccttgttggccttgttgaatgatttaggctgctgtgcacagtggcatctacgactacgacctagctagctaggtactagctttcatcgataaagtaaaaaagaaaagcattggttaataaaacgtattaaaaaaaagtagtgcaatatgcatgggagtaataatatatactactgtacctcacgggctgttgcggaccggaacgtgatcatgtgcgccagcgccgggatgatgtagacggtgaagctgacgaggagggagccgacggcggagttgatgggcccgaagaaggggaagatgatggcgaggaaccagatggggacgacgacggggaggcgcgcggcggc

SEQ ID NO: 267 - DNA, 781 bp, Zea mays
agggatgctgaaagtaattccatacctagaaacactttcatacactcatttgcctcaacaccagcatctgcacaacaataggaaatagaaagtggcttaaccagttcatctgtatgtcggaaataaacaaaaacggatgaaggcacagaaacgtgcaagggacatccacacagatgaacacacagcgcaattaacttgtatgattgtatctcatagagcaatccttatgggactgatagaaccccaaaagcatgatatctcttcaggtttgcagaaaccaaaacaggtctacagtttgaattatgtcaagtgcactccacaaagaaagcaaaatgaaggaaaatgtaagatgaatagaatgaggttcaccatttccttatcacactttaacctgtgtgactatccaaatcctctaaagacagtgcattaggggcttaaccaaacaaaaggttagatccaatgctccacaagcagacaagcaataaattacagacaatgcacagcctcgatccagaaaacagggcaaagcctaacaatttagcaacttctttccacctcctttttactaatagagaataaactccccacgcttcaatgtcgcaaccaccaaattaagcaaggcagacacatctaaatgagaagcagcagcctctcggctacgctccacaggcatatccggcggaagccgccaggtcaaaataaacataaaaatgaacacacgccggaacccaacaagacagcaggcgcgtcacaacacgaatgggatctgcaggcatgcaag

SEQ ID NO: 268 - DNA, 748 bp, Zea mays
catcttgcatgcctgcagcagcctccaagtgctcaccctcagcgacaactacttcagcgggcagctgccgcgggcagtaggcaacctgtcgacgacgcttcagcagctctacctccacaacaacagcatctccgggagcattccggagggcatcggcaacctggtcggcttggacctgctctctctggggataaaccccatatctggcgtgataccggaaagcttgggcaggctgacgaacctggtcacgcttggcctgtacagcactagcttggcaggccacatcccggcttctcttgggaaccttaccgatctggtttacctagatgcacacaactcagatctgggaggcctcatcccagccagccttgggaagctgcacaaactagtcctgctggatctgtcacacaaccgtctcaacggctcggtccccagggaaatcctcgagttgtcctcgctttctttgtcactggacctgtccaacaatttcctctccggacccattccatcagaggtcggcgccctggccaacctcaacaccttgagcctgtcagggaaccagttcaccggcaacatacctgacagcataggaggctgcgaggtgctggagttcctctcgcttgacaggaacacgttagacggaggcctgcctcaatccttgggcaagctgaaagggctcaacgtactcaacctaaccatgaacagcctatccggtaggatccctgacgccctgggcagcatcggcaat

SEQ ID NO: 269 - DNA, 726 bp, Zea mays
tgcatgcctgcagggcgcctgtttgtccccggatcctgtttcgctactgcgtgatacgatctattcgccctagctagagggctgacctctgaacaatctggcgagccactgagcttgccctgtaggagaaggaagaacgtcgtctgctgcgctgagagccacgttcagttcagtggcgtggcccgcagaaaactgcaataatacaagcccaaaagagagaaataatattcctcaagccgatccgattatctcaacacacactagctgctgtttcgctgatgatatgctgctcggcgtatctgaagacccaaaaaccctacactttatacacgtacattttagctgaaattaaacccctatatatcgcacatctctgtctttgctcaaagaatgtttctttggttcctttgttcttgacctgacgttgcatactctcagtctcaagttactacataccgcaacactttgctcattcatccgcatccggggaaggggctatactgtgtcgttttccgagtccaacactttctttgcccgtcttttacccgtctccactatggaaggctcgagtaaagctgatggtttcgctccaaatctgcaaccgcctcaaataaactttgtctcttcagggtcatgcatgcatcgccaaccaacgtagaatctgagcatgtttggtgggtgaagaaggaatgctccatttagctaatcacggctggagcttttcgt

SEQ ID NO: 270 - DNA, 723 bp, Zea mays
aagtttcacattattaagtctgattttcatatctcctgaccacaaaatttttcaaccgcattaccctttacattttattgcctttcagcaagaaagttaatattaaccttcaggacacaatgctaatactgaaccaatatttcatacaggattttgctgataaaatggcagtgacaacaattatagttcctaatgcactgaataatatgacagctacctatagactaaatgtgaaacataacactaaagctgagtagcaaattacctggaccagcagcacgttttttagatggtgtagcaggcaagccctcgatacgaacattctgccttgacactaagtcatcaagagatggcattggttcagccaaaagaccaaggcggtttatttctgaagcaacagatggcctggcaacaatcagtgagttatacaatgatgaacctttctcccatgccatgctttccaaaagctgttcttctaaggaatttaggtgccttttcaattctcttgggagggtctcttcatgtctcacaaagttctcaattattttgctcaaatcaaatgcagttagaccggtactctcaagaacagcaggaaacatcatgatgactgtcttatgtgtcgccaatactaagtccgctgaacatgcaatcaaacatcggtggaaacgctcatttgacagcaatggagttagattatttacattgctgttttgtaactccgct

SEQ ID NO: 271 - DNA, 732 bp, Zea mays
ccatcgtcgtcaacatcctcctccacgggaggcaaggatgtgcgttctttggatcttggactttgaacacaagcaacagctagcaacataaaaaaggggagaaattgggtcgaggaactgacgcgcgaactgattaagtggttggagcaggtggtatatagctccagtagtgcatctgcatgtgtaattgttgatggattggtatttcttgatgatatcttgctcatattagctcacttgtgctttcgttaactgatgtgtgtttcttctctttcttaatttgatctttgttccgagaatatgatattttgcttattgtaattgtacatattctgaatcatctctgaccaagtccagtaattatttaaggaccgcaccatcctctctgcatacgatatcagttcgtcccccactactgtgtgcacatcttactgtttgggtcatttaaattttttagtttttcttgaagcactatgtggccccagcctccgggcaacttcgcaaggctctccccccaaagcaaggtagcaccgtagcagaggcagttattggatgactggaatcaggtcagatcagaatcagaccctagtctttctccttaacatcagatgcttttcatgggtatctctacactgctactgtatcctcatcttggctcttggttgttgtgcaattctttccctgctgccacatctgatattctgattcgcttctgcttccgttgctcattga

SEQ ID NO: 272 - DNA, 812 bp, Zea mays
cttgcatgcctgcaggggccagctgcggtgcgtgcgcaccagaaaacgcatggcccgccgcccgccggggccgctccgtggctccacagggtggagactggagaatcgagatcgagcagtggagcttatgtgtatgaatgttgagttgatctataagggcatgtataatctagagtttatgaaaaataaaaatcattcgaatctgaattcgaatcagtatccatatccaacttttatatttatcttttgaagaggaataggaccaatttgaagtcaatttttatgaatctaaaaataagaatatagatttgcatagcaggctttatatcttatttattcacaatcaagaaacgaagacaaaattttcatatctgaataaattattggatctataacttttttttgttttgttgaagacctagattctataagtctaatgctgacagaagagcagcagctggatagctagttggatagaactgcttttttctctctggggcgtctctatcggcgaaacgatcctcagctcagctgggaggatgagaaccaagaacggcatatcctgcgagatattatctcgattggtagcactaatgcactatgggacacatcgccaacttgtgcagatgagggaaaagcttttgccacactggatagcagatagctattctcgatatctggattcacgatctgaaccaggctcacggcgacaggtactcctgcctttttttttggcacacaggacgctcgatatgtacatgctgtttttagacaaaagtgttactaggatacagtgatcaggctgagagaag

SEQ ID NO: 273 - DNA, 779 bp, Zea mays
tacctagtattccagaggtgatttctcttcattgacagagagcaaatctggttcgtgatccctagtaccagagagggacacggttttcctatcgatgtgttagagtcaagtactcaagcttttgtggttccaatggagtctaagcgtgtgagtgatcaggatgctttgatcgacctggagagtggcaatggcactacagtaagcaactacaccaatggtggggatgctagtttcacagtggggcaagcaagaacagcgcctaatggtgcgtggaatggttgtgtgtgtgccaacgggtgtccgagggacgacaggaatcagcacatggattgctcccctcctgcttcggatgctgttgctagaagtggagatgacaggaagtctgagggggaggagaagcttatggacagctcaggaggggagaagacgaagaagaagcggtccaagaagccaccgcggccgccaaggccgctgacacctacgccgttggatgtttctgaccagaagctcctcaacgaactgagtgagcttgcggtgttgaaacgggcaaggattgagcggatgaaggctttgaagaagatgaagaatgccaagcaagggtcctcgggtggcaatttgtgccccctgatcattaccattatcttctgcatcgtcatactgtggcaaggtatatagatctgttcactactattgatagtggtgccgtgtttgtatgcaacaatataagtttgcgccccatgaatagaacattgactcaaacgtcgaattgaaccttttct

SEQ ID NO: 274 - DNA, 961 bp, Zea mays
tccaaagcgacaagcccctgtcttgagatgaaatggacaatgggccttatcctaaagaaataaaagaaacagaaaaaggtaaaatgtcaagtagagaacaagttgtattttatttctgttgtaacagaataaatatatagggcatttctgtcctaatagatagagaacaatggagcatgcctgttctgttccaaaattcggagtctcttgagcaactttgtcaagtacttcttgagcagacaaagaaggttctctcctatgagcagccaaagcaacagactgtggtgggagcggatttgatgtaggtctatcttcctacaagacatttagagtaacctttatcggcagtatgttcaaaaaaattgccccacaagcagccataaggaatagaaccaacagaaatttataacaaatagaatgtgacctcctgaatttgcagcttttccttggacccctttggtactttaacctttttcttcttcacaatgatctcatttcctttccatataatttctgctggtccatcttcaacatattcccattcactatcttcttctgactggtttccttggtcatctttaggctgcaagagggaagttaaatttgtaaccagatcactattttagaatgtttctacaacttatttttgaaaacatgaactagtgaatttaaagtgatggaataactctttggggtggtcattttgtggaggacagcatcttaaactagaggatatctaagacaacatcttaaactaatcgacatctaggacagcattttagacagcattttaacatatgcttgggcttcccaagcactattaatatgttaccccaaccccttaggtgggaatgcattgggagttgtgtggacagaaaaaatggccccaattctaatgtctattcttcaagagaagtagagttcccttctttcataaaaaatgacatgggcaaaatgtgac

SEQ ID NO: 275 - DNA, 822 bp, Zea mays
actatcagcaccaacatcggtcttactgggtggctgccagcctcaatagtgaatctctcgacgaccatgcaaggcctcatgttggctgacacagggatcgtaggaagcatccccttagaaattggcaatcttttcaacctccagttcttcagcgtgtcaaatacttccgtgtctggtgcggtcccagatagcattggcaagctggtaaacttggttgaattaaacctgtacaataccaatctttcagggcttataccttcatctattggaaatctttcagagttagctgcgcttgctgcattcaatagcaatctggagggaccaattcccaaaagcatagggaggctgaagaacctctatgcccttgatatgtcaagtaaccgcctaaacggttcaattcccatcgagattttccagctaccactcctttctagatacttaggcttatcacataattcattatcaggtaccctacccgctgaggttggtagcttgacaaaccttaacatcctggcgctatctggaaaccaactgtctggtgagatacctggtagcattggggactgcaccgtgttgcaggaacttgggctggatgacaacttatttgaaggagccatacctcaatctctgagcaatataaagggcctaactggactcaacttgtccatgaataagttgtctggcgtcattcctgaagccattggtagcatgcgcaaccttcaacagttgtatctggcacacaacaatatgtcatggacaatcccaattatattgcataacttgacattggcagaataagatctatacttgaacaaactgcaa

SEQ ID NO: 276 - DNA, 791 bp, Zea mays
gaatctagtgaagaggaagcggttaccttctcacagctggtgggatcatcatcgtatttcctttgtttttgtttcttctgaagttctgatccattcctctgccttgccaatataaatgattcaagatataatacacatgcatttcattcacactaggctaatttctcgctatctgttcctgttctttatcattatagttggctgtagatatatgatacatctgtatttcatttacacttggcatcatatattgtttcgtctgcatttctattgtgttcacgtggtctataaatcggtttcttaattttcttgctcatttgcagaacctcatcgatctggcaggttcagagagttcaagggctgaaactacaggagtacgccggaaggaaggatcttatatcaataaaagcttgctaactcttggaacggtgggcctcattcgctaatcactctcagattatacatccctgtaatatcaccattaatgcactatggtagatgctgtgttcatgcaatcatgcttttgagattatgtgttgctgcctatgcattatttgtgcatacaagagcttaattgttttcatttttatatttcatatttgaaccataaatgtgatcaatagaaatcttgaattggatagatatatgtaactatccaaaagtcctgaaacacaggtcacaccaatatatgcagcatttctttttccactgaccaggtacatttataagcattgagacaacaattgggacttgtgagaaaagatttcataagtatttctacttcatgcgat

SEQ ID NO: 277 - DNA, 784 bp, Zea mays
aaatttagcattacaccaaaatgcaaagaaatgtccattgttcaaaaactttttcctatatcatcatagtaattgaactttttcttggaatcaagtataaatgaacagataatgcttgaataccttaaaatatacgccttttttccttccagtgccatcatagcgtattccaataagcttctgtacaacaaattcatccttgtcaagagtgtcagcatcctcttgatcctctgaacctgctaaattcgaatccacatcttgatgaacatatttttcacataagactgcccattccttaaggagagcaagaaactcatcagctttctcatttcgcacctacattcaaaggtccaaaaaaactttttgagagcagctggacagaacagatggaatccaagatgcagcttaatatgcatacctcagtctgtggatgattgtattttaaactttggcacgcaaaactgttaagatcaacagcccatcgctgcaatcatagccataacagtagaatcagtggtaagtaagaacatgttctatccaacagataactaggtagaatattacagtttcaagtttcaggccagaaagagcagcacccaagcaaagaccagtggacatgcccccacagcccgaatacaagtcaagaagggttgctgtcctctctggcatattagatgacgtctccaaacccgcatcatcagaagaaatacccgaagcggtttactgcctgactgcccattttttaataaaaaacaattgtgaggttttgcaaaaaaacatacca

SEQ ID NO: 278 - DNA, 850 bp, Zea mays
caaccttccattgcaagcatatgcacttgtgcagtggtcagtggagacccaacaaataagcaacaacaatcattcaattaacagatcaacacttagtattacaataaggtggctgtcaacagccaacaatgatcattgaacgatctaatctaaatttcgaacaataatgacatataagtctccatatatgacaatataacgtaagtatatcatagattttcacaatgcaaatatctcccgcctaatttaaaatggaataaaaacaggattatcccggtaaaatatgagatactgcaaatatgcacgggcaacaacatcaaccctttttgctcccgctcccgatcaacccgtctcatattctatcccgttttcacacaaaaattatatgtataaaacaagaatacggtatatgataggatttttccctttcgttttatccccacccgtgggactattttgtttcctgccacaggtcgtgccaaccagtaggcagtgtgtcagtgtacaattcgacggtgagactagcgctgcttttgcagtgaaacaactagcgtatctacaatttttggtacgtttggatctgactagcatataggttgtgtgctatcgctacgatctcaagagaggatgggttaacggcagtggtgagtacgacacgagtgaggtggaagtggatgctgggggcaaccaggtcctgagggagggagagaggaagggatgaaggataatccaaatatagtctctcatagattagatttgaagtacgtaagcagaggagggtattcaatgatctgacccttggtttttatggcggggtaaagtttaagggtatttaattgcggggaatttg

SEQ ID NO: 279 - DNA, 762 bp, Zea mays
cccctcttgcgtgcctgcagtgtgtcaccccttgcttggttcatgtcaaatcaggaaactagttttgtgacaattggacaacgagtgcttgccaatccactgaggtaaccatcttggttcatatttcattttacattcatgttgtggttatgcattatctattggttctagtatttcaatctttaggttgtgtgaatcgtcctcttatttgttttgttcttcggggtgttactatcctaagatgtttgctttgtaatttttttcctgaaccttctttattcagggttcggtttcattatggccatcctgatgtcttcgatcgtcttttccacgttacgaggggcggtgtcagtaaagcatccaaaattatcaatcttagtgaggacatctttgcaggtacttttcttttgctgttactgctcaacatttgtaaatgtggaaccactaagataatattttggcttcttatggttcaggattcaattccacattgcgcgaaggcaatgttactcaccatgaatacatgcaagttggcaaaggaagggatgtaggtctcaatcaaatatctctgtttgaggcaaagatagcaaatggcaatggcgaacaaacgctgagccgtgacatctaccggctaggtcatcgctttgatttcttcaggatgctgtcttgttactacacaacaattggtttctacttcagtacaatggtatttttctgacctgaattgtaaaccgctcttgtttattcattggttaacactta

SEQ ID NO: 280 - DNA, 789 bp, Zea mays
atatattatatctgtagctgagctaatgttttagccgctcgcctgttcctgctaaattggcattttgaaatctgttcttgtttcaggactcctatgtggttcaaaaggatgctatcaccgtcgaagaagactgaaaatagtccagtatttaggttttttatggatctgaatgatgcaggtaatgctgtctctatacctttcgttgttcttctctgtttgatgcttgtgaccttagctgttatttaaagtctgttcaaaccattcagtcagggacaataaaaatttcctgaatccagttctcgtctttggatttctaggtcaataaatgtcctgaacccaaacctgagtgcaaagcatccctatcttttggaaccgctaaacatgtatagttaattctgaaatggactgtgaccagctctggcaagacaaaaaggtccacagttgcttattgacctattgggcaggttaaaaaacacccactttggttcctagttctctggatgtagtttacactttcttttgatggtggtaggttgcaatatcttgtaccaagaaaagatgatttatttctaagcaggatttactcgtaatattgtctaaagacacttgatttctcggcagtaccttttctataacaatgttctgcaaatttagtcatctccagcttatttagtgagtctgaaaggatgttcagcacttcagctaatgtggtctatcatttccagtatcctatgtaaagcgactaaatgtgccaagcggcatggtgggggccttgtcgccttgatgtaa

SEQ ID NO: 281 - DNA, 823 bp, Zea mays
attgctgttgaatgtgtctggtttgtatctctaatttctgatttcatgaattggtttacatgtcttacgaacctaacaccctttcactggtttgccattatgttgtcattgatatagcacatgtgtctttcatataatctttgctgaacattgctcttgaccaacatggttaacaggtctgacggggaaatggtattcgtggacgataagcagttgaaagctaaggagcccctggtggtatgacctcattgttttctcatttcacataatgaagtaaaaatggaatgacgccacaacaattattattctggtttgcagcttattgattactatgagcaacaccttcgctacaaccccacctcgtgataaggatgcattgacgctgctgggtttcagttgcatgtgctgcacctatgtttggaacaaatggaaatgtatttaaatgtagcattttttgtgctagatgcatttgtagtattatttgagtaagtagataattagtaagtagccaatgctgagtgcaagtgaaacatgatagcatggtttgtcaaactaactgctcgatattgttactgttttcaaattgtcttattaatcgtgataatcatgattaatcgttcaagtcgatttggaccaatagtgattaatcgtcaaagtcatccgattaatggtgattaatcatgattaatcgtacaaatcggttagctagaatgactaagcagttgtacgacttcaaaacattattgcgtgtattatatgctaagttagttgcttcattgtacatgtggtgctgggaattggagatttttatctgcaaaattgt

SEQ ID NO: 282 - DNA, 813 bp, Zea mays
agacaggacaacggaggtcggaggccccttccaagcaagcaatgccaagaaccaacaagaacacggcaagaactagcatcactacagttgcaacaaatactaaatcgccatcgatctcgacggcaaattatccgctaatcatcttccacctccagctaagttctctgagaaccatcattgcaaaatgtgctgccacaagcatgcaaacattactcccgccataagcatgcaaacaaggacatcttttcttatctctcttgccccccatctgtcacggcaatgggcaaaatagttcgttctcctgctcaccgacgcgagccaatgatgctccttgatctccattctccaccgccaccgaacggcggtctcgccataggcaccgtttccggcacggtgcgtcacgcggcgcaggtggacggccaggcgtcgcggctctcctcgtcggggggtagctgatgcgggacctggaccggtggcgcgaccccggctgacgccgacgccgacgccgacgccgccgctgcgcgcttgggggcccgacctggtggctctggagaggacgacacggacacggacgccgacggcgcccacgggccgaccgccgcagccatagcggggggcggacgtcgagctctcgcagctgaagcaggacagcgcgccgatcacgccgctcgggctcgggggggggcgaagtacaaactggccccgccgcggtgctttacgccttaatttcccggcgctttaacgcccgaaaattggcaaggccgaaggaaagcctcatggcccccgtaacccttgggaaaaaagaaactttgg

SEQ ID NO: 283 - DNA, 832 bp, Zea mays
tttctctctcctcttgacttgttgaggcatttatcgccacctccagttctcgacttgctgcatgcatcttgagaatgaggggatcagtaaatgcccaaaagtccatgccagcacctccccaccccccatgaacaatcatggacagatgctagagaacaaaagagaagcaaagccgctgctgtgactcttgttcaagatatgactactggactgtaactcctcttgaactcgtcttataaactaaaactgggagggactaccagcaaaagcaaacgctctttgcagagttggagtgatcgagagcaagatagcagattatttatttattcaactgctggagcctggtgagtggtgagtggagaacggagaggagaggagggggttgcgagaaaaggaagggacgacttgaggggggtcccggtgtctgttgcagatatgaagcgacgtctctaaaggctatctctactccctatagcagtagcagctcgacacagccaagactgttcttgtctgtttcttctctgcgtgtcacgcgtaggctttactacctgaatagctctgtcagcggcgacctttctgtgctgccgtctctcgttttctgctccttttgcctgggcccctggtctgaactgtaatactgatcgaaacattgtcatatgtaattcagattcagagttttttttttaaaaacaaaacaaaaagcagagcttcgcttaggttgaagttgaagctgagcgaaaagttacaccatcttttaccgaaacttgagtagaatctaagggagaaagacaagtagctccgttctgctaccatatattagtagagtaaaaca

SEQ ID NO: 284 - DNA, 825 bp, Zea mays
gaaagagcttcacatacaacagtaacatcaacattgcagtggctgtggcaattgatggtggccttattacacctgttcttcaggatgctgacaaggtacgtacaatctttgtgataaattcggcttcaattcgcagttttagcaaacaagttcatcaaacagcttgttgaatgttacactgtagctggatatatatttgctctcgcaaaattggaaggatctagtgaagaaagcacgagcaaaacagctccaaccaaatgagtacagctctggtatggaattcatggcattgcatagtgtattagattgcctttgcaaatcttctatgaacatgcttacctgaagattatttgcagggacttttacactgtccaacctgggtatgtttggtgtagatcggtttgatgcaatccttccacctggccaggtgggcttacttccttttcttcctagtctatgtaaactgtaatatgtatacaaagattaatattcgagtatcaatgagtgcagggagctattatggctgttggagcctcgaaacctacagttgtggctgataaagatggtttctttagcgtcaagagcaaaatgctggttagttgtgtacctgattgtaatagacatctgttatttgcatataatgtatcagtatggtgaaatgtttatagttttacttctacatcctaccaattttttaaaatgtattcatgacatgtagttattatgtcgtagaggtttgtcagatatatcatctgaagtgtttttcatggtttaatgcccttagttaattatgatgattagatgtccaatagtattgcataatta

SEQ ID NO: 285 - DNA, 734 bp, Zea mays
tcatcgccaagtacaggcccaccatgcctgttctttctgttgtcattcctcgtctgaagacaaaccaactgagatggagtttcactggtgcttttgaggtacgtgaaccccaatattctttgtgatctttcctgttagatgttttctttttatgcaacactgacattatctattattagcatgttgatcatttcttttgtgaatggtaacattggtctttgaagtttctcttgtagatattgaacatgtgtcatgcaatgcttaagagagattactttatttgagaagaattaagaaccttgattgccttctcttgtactgatacttggcaccatgcaactcatttgttgtttctttttcttgcaggcaagacagtcgctgatagttagaggcctctttccgatgcttgctgatcctcggcatccagtaagttaactgaagtctttcagttcactactttgtataagcaacacatactggctgcactgctcacttgtacacatgagcaactcatttctagcatcgttggggatggaaagattttgcaaacacatccccattgcctttgtattcttggacaagcattttttttattcatctattttggtaagatatccgatgaaaacttgatggcttttggtaagcagtatgatactgctaggagcctaggacccagatatctttctttattaacataacaatattatcatattatagatttatagtgtacttgc

SEQ ID NO: 286 - DNA, 836 bp, Zea mays
tgcaaatacaatacgctacaagatggccgtcacatgcatatacatgtaactaggccacgcgtgtgtgccacgcatgatgatgctgacatgcatgacggtaatgaacaattgtaggatggcttcaactgcgaggtttctgcatcgtggccttaaaataataaagaaacaaacacatacacacacacactgaactattatattgtaaagaaaaaaaagatattgcattcccatcagatgagactcttatatatttgcgcacttattgttgctacaaatgttagcagaaatagaatccatgcatcagacttgcaagaaaattaccaataagagagagtagggatgaaaaggggtatctgaacagttaggataaatttaatattttaaaatatatatgtatgaattttgatgctaatcttttcttacatgttatgaagcacattgttatcgacaagaataaatttttgcataactgtttttacattatgtactccaaaaaaagtgaaaatatctgtatattcggattttatatctatcatctaagaagatatacgatagatttgaagtttacattttatgaatcttaacaagctcaatgctaaaaaacaagaatatgaatttgcgcagccaattctatatcctatttaattattcacagtcaaaggaaaaaagagaacaaagtaacaggtacgcggagaagtatttgttttcatccctaaccattaggatggattagttagagaaatatttatggacgtataaggaaatttaaattaaaaaaggattaaggaaccctaccatgtgttaagtaaaaggaaatatatttccttattgaaaga

SEQ ID NO: 287 - DNA, 791 bp, Zea mays
ctgcattccgcaaggcaaagcattcgtcccaccttgccaagggaacaagcactagtgcccaggtatgctaagggaacaagcactggtgcccaggactccagtaaggtcgatgctttgactgagctgataaatattaaatttataataatatgggcgtttggggcttgagcctgaaaaattggaactttcctatataagaaacaggaactttctccgatataaaaacgggaacagagaatatggtcctgattatcctattttttaccctgtttccatattttactgaaagtacgctaaacaatcggtaaatacgataaacggtgtcgatcggtacaggacttctctgtcatgtttttatctccagctccagctgctatggaatgcattagttttgttggaaaagtagaatgcagtaacttcatagcattcttttgtatgatgtaatctctatatgctgattcagaatcatgtctgttgcacaggttgctcagatatgatgaaccaatctctcttcttggttggagaaatcgggggcaatgactacaacggacctcttctttctggagttcccatggagaaaatccgtgccatcactccgagtgttgttgcaaaaatttcttctacaatcagcgtgagcattagttttattgtaggtgttgtagctgctaacgtcatatatagatagtaatttacaatacgttgagtttgcaggaattgattcggctaggagcccaagacttttgtggttccaggaaacctcccaattggatgcatcccagactatctgatga

SEQ ID NO: 288 - DNA, 821 bp, Zea mays
aataaacctttgccgctaaagtatgtcaagttccaaaatgttcgcaggtatatacatttcacgatatatatatatatgcttttgtttcttgtcactgtttttatttaacggccttctgttattatttcagcctgactgtatttattgaggacaatcaatctggaagtgatgtctcgaaaattcaaaaggttgctctttatggcacaacgtaaggttttcgcttccacatgtttacgatgattgccattgtttccatttggttggttctatttccttttccacaagtgctagattataaagttttgttggtgtgaagataagaaaaaatgataatgttactgaaggagatccaagctggaccagtactaactatttgggggagaggagaaattgcaattctggaacatgaacaagaattggaaacatgtattctttgatctaataaaattaattatgtttgcgaggatatccatagaaattgaagcttagtgatcaataggatatctgcgtgatatgcaagtgcaacagttggatattgatgacagctatatattttgccatttctctgttcatttgtacaagcagggtacgtttacaacctgtatagaaaaagtagctggaattcttcttggtctaataactggctattttattttagccaaaattgaaaggtgaaggaaatcattttaccaaatcagataggaatgtgcttaagggagggggtgcattgacaagcatggagaacatgaagctcttcctaaattcttcacatatgcatatatgatggaggtggtccattttcctgaatctaaattgctggt

SEQ ID NO: 289 - DNA, 859 bp, Zea mays
atagaaacagtagttcgaggtagcacaggcagttgagatggagtagtttggacccatgaaaccaatgtccattccaagcagggcagaacccatgtttgtgatagcatatgggatgaagaaaggagttatctttctgtatcccttctcaatgagattctggacaccatccgaaaacaccgtgaggccacccataccagtgcccacaagcacaccggcccgggtcttgtcaatctgccagagagaatattttaccaattagcatcaaatgtagcattaacagtgaaaaaatcttatagtactagtaaaaatatcaaactaccagatgaaactactatcaatacagtacaaaccatagtttgatgtgctagaagacaatttgatttaatccaaaaatgctactccctctgacctgtagggcgtgtttattttgaagaaaccaaactcgtaaacccaaccaacaattagtcaaattatgtgtgtttggagtacaaaagctatatcaacagatttatactcaaacaacttttaatgcgacattgattttgcagagactagcaatattataaaacaataatggttaaaatatgcttctaatgacactatccgtccacaatatgcctggaaaaaggtagtactttgctagaaaaatcaccataatgcaagtgaatcatcaaacgaaacaacagattttcgcagagctatgttaatacgaattaaacctgttgtgcctatgttaatactgttctaattgtaagacacttgtcgttttgccctacaccacggtttgcaatggaaatcgatgcgctaattagccaatagccactgtagcattggctactactcaaaatgagctgtctat

SEQ ID NO: 290 - DNA, 743 bp, Zea mays
aaagttcaatcaacggttaaaaaaagtgatctgaatccggtatggaatgaagtgcttaagatatctgttcctcgaaattatggacctctaaaacttgtaagttttatcattagaaccttttaattattttccttatatccaaaggattctagttcaaataagagtacaatatggtaagtgtcatgaattatggcaaagtccttagggtgtttccttgaatcagtcacattatacttccctatgtcccaaaataactgcacacctcatttttctggaagtcaaactttttaaagcttgactaaaattatagaaatattatcaacatttgtatatcctaatgtatattatgaaattaatctaatcatacttattgtgcatcataaatattagtatatttttgtatatgtttagtcaaattttcaaaaagtttgtcgaagaaataaaacacttcacattatgcttcaagaaaagagcagagtgttgagaaagtagccaagaaaaaagctgctggctattagcgacatgaaagtaatacacataatatctatgtccaggaagtgtatgaccatgatatgttctcagctgatgatatcatgggtgaagcagagatagatctccagccaatgatcacagccgccatggcctttggagatacttcacgtcttggtgacatgcaaattgggaggtggttcatgaccaaagacaacgccctgatgaaagatagcacggtgaatgttgtggca

SEQ ID NO: 291 - DNA, 874 bp, Zea mays
cccggggaccctctagagtctacctgcagaactaagtggtttattagcattaggtatatagcttggattcaaatagttttggaaagagccgatgcattaaagaaactgttggccctgctctcatgggaactagtacagaggcatcatagtcatctactcatctgtattttagtcttcatggactaggaaggatggagatggcttccactggatgatttttatttattttagtaaaacatggcagctgttagctatatgactgagatagattatcaaatcatgtcaatgtaatttctaagtttctggtgtccctatgttcgacaatgttttcttgttgtgatactgagtttctcttttcccttatttttcttttcaggccactcatatcacttgcttatcctctgtaagtatctcctttgtccttagttgactgtctcagtattttcctcttgatactatgtccaggggctaagccaggatttgttttttttttgggagggggacaaatcagattgagggggctgttagggaggtattttagcttatttgcatgatgattagctaaaataattagtggctcctatagaattacaggagcattggggggacattacagagagcctggagcaatgttacagtggctcctaactatgtcccaacctctgcctccctgtcttcgcccctgactatgtcactggcaggagtaaataggaaattggagttgtggctaaagactccggagtccaaaggttttatacttagtagaactaaaatcaaatatatgagatgtgactccggtactactagacatgaggaaagagatgttagttgggtactttggtgtccaagaagaatattttcggtattaatgaac

SEQ ID NO: 292 - DNA, 825 bp, Zea mays
tgaatcccacccatcttagcttccattactaatctcgttatccacaatttctccctcttttgtcaatcgtgtttggtctgattaggagagggcgctaaggaagatgtccggatcaccggtgttactgtcaatggaggactcctctactgccaacgttagttttcttcaactggatttgcttgaaattggtcttgttacaaaatacctgctgttggtgtatcaatttctttggggtttgtgattgcaaagttatcagatgatgaggatgatgaaaaattgggcgatgctgatgaagatgctgagagcgagaagctcagccaacctgttgacaatacgtctgataagcctgacgcacccagctgccgccttagatctggtatagaggtttagttcttttcttgttttacatagagccttctatcttttatgttgtgtgctcacttagagttttggtgttgtatacatagatcatcggaaggagaagtcccttgggctcctcactcagaattttgtcaagctcttcctcaacatggaggtgagaggactgaattcaccctgtatggtttgggttatttccctttcgcacttaactgtaatgaggcttgtatttcgtacaggttgggacaatctcacttgacgaagctgcaaggctttttcttggagagggacatgcagacagcaacatgagaagttagtacatgcattccttttgtttaattccatgcttatgcccaaatatttttcatatccaaatagaatttgcactgattctaatatgcaaaagcacccaaagtcgtcgattgtatgacattgccaagggcttgc

SEQ ID NO: 293 - DNA, 829 bp, Zea mays
acctgctctttttgcgccggctcccggtgggggcttagcgtggtcgttccaatgggaatatgatcgttcttatagcgtgtgtggcgcggactatctagttgtggatatttggccttttagccttgtaataggggttgacaaatattgtccccctacctatttttttctccttaatgaaatgacacacagctctcctgtgtttgttaaaaaacacaccaaatgactcttagtagcccacagtacacgcggataaggcaaaaggttaaaaggattactccacacagattaaatcaaatgataaagtgggcctaataagcctctacttgttcaagaagtagaaatagaaagactcactggcaaaagcatgagtattcctataggaacgacagacgccaaatctgtcaatgttctttgaagagcctgcttttccttctgagttagttcatccccaataagagctctttttagcaaacccatagcagctcctgtatcaattgctaatagttgtgtcccctgcaacacagtctgtgcagaaaaaaatatgaataaggaacaagtttttctttaaactagtacagtgggaagtatggagctaacaatactttgagtgtgtgtttgtgtgagtggtgtttaggtcattgtaattatcatccttctttgaatgaaatgatacgcagctctcctgcgtgttcgagaaaaaaaaacaatactttgatgagcggctttggattggcaaatagtcttttggataaagttaattcgattattcaacccccctactacaatctttcacaatgataccatgtcttcaagtgtcattatcgtcagc

SEQ ID NO: 294 - DNA, 779 bp, Zea mays
cttgcatgcctgcagccaagtagctcaagtacatcaaattcaatctaaaaggaagtgcagcaaatggcataagagcatgtgtgactgagtgcaaaagcgggaagagaagcttcgacggcagcaaatggcatacgagcatgtttgagacatgttttatcatcaaaagcggcaagagaagcagtgcctcacacctcttgtccgggcgaagggctccccaatgcaaaatcagggaaccgcttgtgttggtcacctccaggctaatctctgacaccaaaccctgcggcgctgggttcactgcgacctgttcccacacaatgcaccaatagtgttatagagataaaaatcgtagcagatgggtgaatgaacctggtatccagcggtcgcacctggagctcggagttggaatccagcgtgaactttccgataagctgcgacaagagcaacggaaagacatgaaaatgaagcaggcaaattgccaaacagtgggagaacatcagctgatgatggcccagcggcgaaagatagagcaggcatgaggtgcttacgtcgggggacgcgcggtccgcggacgtggcgacggcgcgcggcacgacggggccgcggctagaggcggagagcgtcgtggggcggcgctggcccccgctgcgtcggagggacgctggctgcggctgctgctgccgcttccctggcgaggaggccgcgggccgtgccgcggaacgcgagcgcgcaccgttcaacccgccgttggcgttggccgcggcacctggaatcccggacat

SEQ ID NO: 295 - DNA, 849 bp, Zea mays
aggttctgcctcttgcttctctatagagcttgtggctggcacaccagcatcactaagacgagcatcaccaccaatttgtattgaatcaggcccagtgcttgaagattgtgcttggctagatggaagtgtcttcttctcatctacaatggtactatgcacttcaggagtagatccttcacctccggcacgagaggcttcttcttgactagcaataagtgggctccccaaatttctggtctgactatcgtcaggagaggattcctgatcccttgatacactgtcactagcatctggtgtcgagattgtgacctgacgagtaacatctgtcggtggtacagtcgtttggtcagcagtggcagcatctgtatcttcttcccttggttcagcagagtcaaatgattttgaggccttatcagatttttcatctgaaatgaaagaaacaacctcagatgtggcagagtagttctgttttagtatccattttttctactaaactggaaacaaagatgcacctttagttaaccaacagtaaacatactaaaacattacctgatgcagcaaaattttgttgggtatctgacgttggaaaaactcttgcgccttgtggagatgtcagttcttcttgaccaaggattgcttgtgatgcgtgtgaaacatgtccttgatttagatcaaatggttttcctgagtcatcagtgccatgtttatccggagttaccacctggattttccctataacactctgggtatctgaggctggaattcctattgtggttggtgcagatgatctggcctgttgctgaaaactcatttgcagctcattagtataattagctgcaggcatgcaag

SEQ ID NO: 296 - DNA, 829 bp, Zea mays
gagggacgggatgaacctgatcccatacgagtacgtaattgctcgacaagggaatgagaggatagatagtattctaggccttggtccggcttcaaggaagaagagcatgcttgtcgtgtcagagttcatcggctgctcgccctccctgagcggtgctatccgtgtgaacccttggaacatcgattcagtagccgacgcaatggactacgcgctggagatgccggaaggggagaaggtgttgagacatgagaaacaccacagatacgtgagcacgcacgacgtcgggtactgggcgaacagcttcctgcaagatcttgagcggatttgcctcgaccataacaggaggcgttgctggggcatagggtttgggctgaagttcagggttgtggccctcgacccaaacttcaagaagcttgcggtggagcacttggtctcggcctaccggaggacgaagaagcgcgtcattctcttagactacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggtaaaataataacttcctgctgtctcccaagcagttcgtgatctgctactgctggagagcacacacactaatcgctgatgctgtcgacggttgtgtaggctgagaagagacgcagaatgggagacatgcgttccggtgatagactgcaggcatgcaa

SEQ ID NO: 297 - DNA, 839 bp, Zea mays
cctcttcccagctcagtggccaacctgtcacaaaacctgaaagagtttgtccttggctcaaacctcatcacaggtgccataccatctgggatcggcgacctggctaacctttccgtcctctacttagacaacaacatgctatctgggcacatacctgcttctattgggaagcttcgcagtatgtttgctctcaacttgtccaagaaccggctgtccggagaaatcccagcatccataggcgacaactgggctcagttgaccgagctttacctgcaagagaacagcctcagtggagccataccagcagggctagctggatgcagaaacctgctggcactgaacctctcgtccaacgccttttctggacctataccggaaggcctcttcggtagactggaccagctgaactggtaccttgacctgtccaagaaccagctcgcaggctccatcccagacgaattcagcaacatgatcaacctcgaatccctcaacatctccagcaacagcatctctggtaaaatcccctccactctcgggtcgtgcgtgctcttgcaggctcttcgcctggaagccaactccctggacggtcaaatcccgtcgtctcttgccaccttgaaaggaatcaaggagctcgacttctctcgcaacaacttgtctggtaaaattccagagtttctggaacagttcgatagcttgcagtacctgaatttatccttcaacaatcttgacggccctattcctacgcaaggcgtcgtctttggcaatgccacaagcaggcttttcctccaggggaacccgaaactgtgtgcagaaactatagcagtgctaggcctcccact

SEQ ID NO: 298 - DNA, 808 bp, Zea mays
acgacgtgacgtcctctctctcttctggcggtccgggcatttcgtggtcggccgttggggctcagggcgtcgccgtgggctttgaccatggcacggcatgaggcgacacctgccggccatgccgacgactcgccagagcagagcaccaacgcccgcagccgcaggcagcaggcggcagcctttttggtgcggccacctccgcctgacggacccagctgccttgcctatacgatgccaccagccaccccgacctgtctcgtcctcccgttttatttcagctcagctcaacaaaaaagctgctgcctgccaacttgggagcccattcctccgccctttccagttcaggtgcaggttcgttccggctgcgcacgagacacgagccagagccacgctacgctctcacgtgcagtgtctgtcacctcgcaagtcgcaacaccttctaagacaccacagaggtatccgattcgccatctggaaatgcacacgaaacactcgcatcatctactaaaacgcaaagacagactgacggcgggcgggtttcattctcggtcttgaggggtacaacaaatacaaagcacgctactagtacaaaccataggaacaggaaggagccggctcttacacagagacttctgttctgttctgttcttaatgaggtcggtacaatacactacggcaaaacaaataggtaggacgagggcgtaggcggcggcggcgtgacgatcgatctccactccaggcgacagcgcactagtgagcgtgagcgtccaccgtctagtggccgcccgatcgacggttcctcgtcagt

SEQ ID NO: 299 - DNA, 924 bp, Zea mays
agtttgcatgcctgcagtggctttcgaagcagacgagcgggaggtcacgctgcgagccttggtcggtctcggcggttttgcgcttgagaaatttggcagtttgagcagagaactgcaaccaaaaagtaaaaaaaaaattactcggttattattacttaattaatcaaatgcgatagcaagcacgctaagcatactcaaggagagagagagatgtgtgtaataagcaaacctgcaaaaatcaaaaggcggtgttattgggacaaggtccaggagcgggtgatcctcgccctgtacatttgctttttgttgatcgttctccttttcttgttgaggattttctgtctggtcactttcttcttgtttcatttcttcagggagttcagtctcggctggtgcagcaagtgcgccaacaaagcaataatgatcagagggatgagagtgcgtaaatgtagacatatccaggaaataaaagttgattattcagaaatctgaaacgaccaaaaaaattgcaaagacaaaaatatgctctctgaaacctgatgtcttttttttttacagccaccacctacgctgtcatagaacaattttgtttgcacatgagccttttacagtggtgtctcatgcgaattaaaatcataggcaaggtaatcctattgttgttcggtgcatagaaacacttttttaatgagaataccactgaacttctattcttttaagggatgcatcagaagttattagtatcataatatagtcagaaaaatgccccaggatgggactgtactgtacatgttcctaaacaataattacgaatctgcaagacgaataagtatagcatcgttatacaaatctcaaacgctaaatactcaccatctcttctgccaaaagcattttggcaactctcacatcaacaggtcgatagagagg

SEQ ID NO: 300 - DNA, 877 bp, Zea mays
catcaagaaataaacgcagagattatcccaagcaagagtgagcagaagttgcagagtactaactattctaaaattttattatgtaggccattacattaagtaccagacttcattttgccttaaggtgtttaacttctggtgaaacccataacagcacctctaccagcaaggatacaacgtcctaagttacttttccatcacatagggataacttttaggattctaacctgtattcaggtttcagccacttctcgccctcatccaaaagccaggtaatcttctcacaggtggtcattatctctcctaatgaagcatcaaccatagtctttccagtgtcccgagatgataccctgcacagcataaacagaattgagctcacccttccagatgtcaggacgtgtgaagaagttttataaaagttgggaccttactcgcatatgagatcctgatgttcaagtatatacttgagaaggattcgaagaaactggcgcctttgcttgaagctgctttttgcccatatcctttgagctttcctggattgtgcaacatgttccttgacctgattacccagagaattgaattgaccatgatgaaacccacatgaagaacacattaatgaagttcaacatgttgcgagaacactacatcggttcctcaactattcactggttaaatcaacaaggggtgcactaaacctctagataatggcagaaatgacgatgcatgacgagagagaccttaaactaaaagaaaaaaaaacaaggcagcagcatacctcatcaggagtcaccactgggaagtaccccaagtatttcatggtcgctggttcatagcattggaccttgtcagtctgagttgatttaccccttctcggtat

SEQ ID NO: 301 - DNA, 757 bp, Zea mays
cagccaaaagcttccatttgcattgcgatgggggctctacctcgtggcctgctagctggcatctgcgccgtcttgttagcagcagtggttgcccttgcccatggtgcggaacaggaaacagcgtcaatggtggtcggcttggccaagtgcgccgactgcaccaggaagaacatgaaagctgatgcggcattcaacggtgcgcgggctgctataatttatccaaccatttgcaatttgcattttgctgggcaaaccatttgcaatttaccggtctatctcttgtttttttgtcccttcaggccttcaagtggctgtcaagtgcaagaacgccgacggcgtcttcgagaccaaggccctcggtgaggttgacaagtccggcagcttcagcgttcccctcccggctgacctcctccgcgaggacggcgagctgaagcaagactgcttcgcgcagctccacagcgcggccaacaagccatgccccggacaggagccgtcttggatcgtccggccaaccaccgacaacgacgacgacgataagatgaagaataccttcgtcgcagtcgccggcaaggtgcactacccatcaaaggagtgcgcctctgctttcctcttctaccatttgttcaagaagcacctgttgcacaagaagcccatggtgatcatccctcacatccacaagaagcccatggtgccgatgtaccgccactcgcccgtgccggagtacaagccacctcacccgacgcccaccccgatctac

SEQ ID NO: 302 - DNA, 846 bp, Zea mays
accgcggtaaacccatgttatgtatctcattgatgaacatgactcaaaacaaacactactcaaaacttcatttaattagagacaatttggcatgtgtttaaaaaaaaggtaaaagtagactgctctatacagatttaggaataacatacgataagccgcactagaacatctgattcctatgtttctcatggaatatatataatagaagcaacaaaaaaagaaaagataagaaatgcactgttaagttataaatgagataagaaatgcactgccaagttaataacgagataagagatgcactgctaaggtaatgtgaaaagctgcaccactgaaaaaaaaaatctgaaacttctgctcaacaatgtgtgagacagggcatacccatatccttcttctgaccatcccgcagtaaaaattccttctgcggtcgtaaagccttgatgctccattccatggagcagcatatttgcagcaacagcgtatgtaacaccagtccagatttcacgtgattgcatgcatgtctcgtccacctttccctttggagtcataccatttacagctcccatccgtcctcctttaaccttcatcacattgaattcaaatattttttgcagagcagttcttatcttgtgctcatcgaaaagcgggggcaagcccgacgaggcagcataccactgtcctgccagctgatcagcctgaatggatctactattgctacttgtgccgctgtcgtaattgaaatatgacccattccataacttcgcctcatatactgctttggcttttataaactttagcttgtacttctcagcaaagtgccgatccccaaggcgatgagccattgta

SEQ ID NO: 303 - DNA, 851 bp, Zea mays
agatcaaacatggttcaaaaaactgctgaataagaagatagaggactgtaatgagtggaaatgaaaagtgaaaaaaacacagatctaaactaagtgagaagaaccataacaataagcacaagcagcaggcataattcttctgctatcagaagcatgttactgaagttcaaagcaagcagataccttaagaaaaaagcatatgctatataacatgcaccatccaacttatactacaatacagtggcatggcagctgaaacttaactaaaaataccacatgccctcagcaccgccaaactacagcacataatctagcttaacacaatcagccctctttgaacctgtggttaccgattgcttgcaaccaaagaaaatgcatagcattgaaaacaagagataagaagaccatttgaagctgatcggacaatcacagagagacatgtgacaaatggttgcccgagcatgtcagcctacatgaactgtaaattactcagcaaccgatttgtaaaccacggaaaacactgaatcgaaacctaaaaacaatactaaatatgcaggttataacttatacagatcacacatcacagcaacatcaattctgaaaccaaggactcaggcggccaagccagacgataaaagttcagacttcagatatcgctttgttaccctctccgcgatgctgtgggggtcggtcgcctgcccacgccgcgcccgcacctttggcctcggtgccggcggttgtggcccgactgccgcaccgccttgcttcggctgctgcgcgtggaacacctaaaacccagccaggacacacaaaaacatggctcggttagggctgcaggtaaactatagagg

SEQ ID NO: 304 - DNA, 897 bp, Zea mays
tgcatgcctgcagctaccacattaatttcaggtacagcagcagctggttctgctataatagctgcatctgtggtgctgctctctggcttttttttgtttttcttcttggatccaccaatgttctcaacaagctttgagccagatgacaaatgctcaccatgctcatccaggctaggaacttcgactcttccttttgcttttttggagctagagctgactctttcagtaccaacataatcaccattagaatcttggcctgcatggcctgatctactagcaaacctttcattctccgccaacctggatgagtcatttgcatcttcattaatttcatgcagatcagagttatgataaacatgcatgtccagatttcccgcccctttccgcttcctttcaccacttgctgctggaggtttcatgacatcactaatctgttctgtcaccatcacatccacatcacgtaaatagccagtctctgaacccttcccttcgaatcctttgctctgggagggttctaaatctgcatcagtagtaggatagttcattttggccactttagcaagcttgtttggctttttggcaccatgtgctggtctatgatacccagaatggtgacgctctggcttccgttcaagataatgcacttccccgccatcttcaaacttttccgaggaatcagattctgtctcatcactttgagcatagacagcattgctcctggagtgcttctggccagtcctatctagttgtgtactggatttacctgccatcttcgcttgtgatatcttgcttctagggtcagaaccaacatgggcatcattaacctgctggtcaatacttttataggacttaaccttcaggccataaccagcttgatctttcctgctcctgtaatca

SEQ ID NO: 305 - DNA, 1140 bp, Zea mays
cttgctgcctgcagggcttcttgatatactgctctctcagcgtaatctaagaccctattttcaggattaaggcgactgtgtgtctcaaagcccttagcaacttcactgttattagaattggttgcctcaaacgttgaaggcagtaccctatgtgagctagaacctccatatacaatgacatcatctgccatataaaaaggggtaaagattaatcttactacagaaaatctacaccattttccaatgcttgtgttattgatcaaattacatcatgtgatgctagcatacccaccatcatcatccactttatgggtattaagtgtactagaagttcctcttgccattattgaagatgaaggctgcaaatttccattggcaatatttgtccccattctgttttcaccaatatttggtgactttttggtggataaaggcagtgggagcttgcgtgtttcgctagcaacaattggatgcatagattttgatgtgttgccatttgaaaaggatgatggaaggaccctcttgttattgtcatttgcatctgctgtagaactgttgtgcttttccactacgctatcaattctactggaagtagaatggcccggtcgcatagccatataaggatttgcatggggatgaatcctgtccactgaaccaaatgtataacgactactctcagcatgtctaccattcgtaagggatgctggaagaatcctgtattgaccattgttgttctcagtaggcttagtcgatggtggagcaggagcgctcctttgccaatcttcatcctcaaaattgattattcgtccttcagcattttgatcaagccttgcgattgcagacgctggctggtcgtcatcatcgaatattgagccaattgagtcatcatcactatccgaaataataatggcagagttttcattcatattgccagcaagcacgtgcactgtatatgtgttcttagaactttgtttttcttagcatgactaaaccattcatgaaccaatggtttgctttctatcttacagaaataaacagcacttccttttttcagatgatcaccaagctaaaagagagagcacaccacccatctcagagtagcactcacagttattcgagttaccctcactgtgggagtaa

SEQ ID NO: 306 - DNA, 1097 bp, Zea mays
aacagatgtgatgtcagattgtttggaataaccagataaacatctatcgggttgactgattcatatcctttcagtgttgctgagaactaactgaatgaaagtaggcagacttctgaattaattgcaattttgggaagtgtaacatacaaaaattatcttgtgtccgaggaaatggattgattgattcagaaaaccaaccaccctggttgtgcaaaccaaaaaaagaacaatatagagcagtaaaggttgattataaccagcattccagcaatgaagccaacagtaccattacaaaagcaatgaagtcaacatgagacatacctgaaggataaggcacgtatgtcaaatcacttgcagcccactgaatatggaatcattagtgatagaaactgatattcaaattctattgcatagagggtggttacatatatagacccaggggaaccctaaccctaatgggctagcagcccatttacacatacatggataatataggagcatacactctaacaatcagtctggtggagaagctggaaatacacagtacaaaagtagcagaaatagagaaagtacttaaaaatgagaatataaaaggtcaaatagtttagagttgccatacttatacttgtgaagaatatgttcctagtcaggaaagcaatttacggttgccaacgctagtgaaaaatatgaaagatatgaatcaagtacagtactatttgacgaccaaatataaccttgatgaatgtctcccaacaaccagccaactaggataaggatttttaatgtcaacccactgaaaactaaagattcattagcattctacaaagcagatgttacaatctaaaatatgttcaatcagcagggaaatggtgataaaacctcaaagctaatttaaaacagtttgctgcctataaactgctggttctcactaacacatacatgtacagttaaatcactccagtcaacccacttattcagaagaatagactgctatggagctgtgagctatatacgagagagatcgccatttatatttgatcaagtatctggctttctctttgaaagggggctaaatgcagctgcaggcatgcaagatg

SEQ ID NO: 307 - DNA, 1091 bp, Zea mays
tgcatgcctgcagatatattatctaatacatatatacatgtttagtccttaaacctgccactttctggcaattggtcatggtctatctgggcattgaagtactgaatcaaggagaataactatgaacagtcaaaaaaaaaacatgttcacaggttagagagaatccaccaaagcatatactaaaaagtgaagaatattaattgcatgagcttaagaaaatactacttcagatgagaagtataccatttttccaacacctggtgatcccacaaatattattttgtctactgatgatacaagagcttggcctgtttccgcaaaactaaaaaccaacaaaaaacagagtccgggtaagaaatgtgcagctagcctgtaaactaataagaatttagaaagctgcactcatacccagttattatgtgcaccagattctcaggtgcaccaacagctgaaagagctgcttgtataatacgaaaataaaagcagcccgaccaagtcgcatgttctgagacctataaaaggtaattttaccattcagaataatcatgaatgatgtataatgcacatcagaaaaattagatattttagaggccacaaaaatgtctatgagcagcacaaaggcatatataacatataaatacatttaacttagaaaaacaagaaaataagttaatgacacaattgtatgcagtattgccatgctacattctttctcggacaatgcaggaggaagggagagaattctactagcattcggtataaataaaaaatcaatccaataaaagctcagtagaaaattgttctgcatttatttgacaagggtgctttctatgagccaacatatgctcaatatgaaatttactagtctcttgaagatcatactaggttaacccaacaaaagtataattgaagataggatacagaacataaattatagctctcagcttcaatggtggcacataatacatgagatataaagattgctgaataacaaaaaaattgatctatgggtccacgtctccacgatatgtacatgaaaatggttggttaaagaacaaatttaaaaaaaaatgacctgcaggcatgcaaga

SEQ ID NO: 308 - DNA, 434 bp, Zea mays
tgttccttgtgactgacatcttttcttcacacgatctcactgcacaaagatacaatgtatgtactaattatgcttgaaagaatttctggtactcaaatctcgatgacagaaacaaacgcaatgtattaaaatctctgaaggcatactttctaaccaaagggaaaaacaattacctgcactgtgggcagcttgctgtcggtaattaatatccatatcccggttggcatgtctgagcgtaagcgtagggatactgaggagaccaaacgaagcagtcgcgtccgaacccgccgctgctgttcctttgagcctgccaatatttatgcatgtaaacaacacacagcttggatggaaagtagcaaataaacaagcgacgggaattacctgcttgtcagcagaagggtaaccccacgaaagttttatggctttacctccca

SEQ ID NO: 309 - DNA, 383 bp, Zea mays
tgtttattccataaggtgcagtccgagagtcgtagctatttcacaggctactcaggtatgcaattttcactgttccagagcagttcttggatcatgagtgatcctgatggggaaaataccttttgcagatacattgttttgatgccgcgaccatggagagagaatatactgttcttaccagtcctacggttgcacaagtttcaggctatggcccacttggattgggtcctagatggattgcatattctgggaatccagttccggttccagatactggacgtgttagcccacagcttcttagtctatctccctctgttccacctcctggttcaaatggtagtgtggtggcatattatgcaaaagaatcaagcaagcaactggca

SEQ ID NO: 310 - DNA, 354 bp, Zea mays
tgacaatttttttaaaaaaacaatattagacaattcattatgacctgcatgcctcaatgcatacactccccagatccagttttgattcgtctgcgctatttcatgtgccaaatttttcgatggagtttgtctaaaatggcaacatgctggttcccagttatacattggtcttaggctcttagcatatcattgatccttttgtgtaataagaaattagggaatctactttcacatttagattacactaaatttatggaagctttcctttacctcaacatcgtcccagaaattcttttcccagcgatatacatgggtttcgtctatatgcgctaagtcactgttatgttcctttca

SEQ ID NO: 311 - DNA, 378 bp, Zea mays
tgcatcaagtgtctgaatgaaaatgaaacaaacaaatcagaggactgtaaacaaattaaagctaatagtgaaacaaactgggatgacaaagaatgaggacgtacattggaagcaaccatcccaacgatgctgacataactagggttctttgtgccatccccaataggaataaactggtaaggaactgggtaagggagcagtttaattgctgacttgaaaacatcaatgcagtaacccctcacagaatcaggggtgctgcctgacaccaatgccttgaagcttggtttaaccgggaccccaactcttagaggctggccatcgttcgggaacacccagcctctaggtatatcagtggagtcaccaggccataccacactg

SEQ ID NO: 312 - DNA, 792 bp, Zea mays
tgagaaatctttatcctcaccatgagaatgtttacctgatgaagataaaccatactttcccatgccaggagaaatgcaactgcgcttctgaatgtttttcagagtctcactggcaggactacttttgcttatttcaaactcagagggttgatgcttcatcacagggccattggattctttcttcattttctttgatgctcgcaggttatcatgatcaacccctacactgcttctcattcgacgtgattgatcttttccaacaatttctcctaaagaaatgtgaatctttagaaacaaaacaacagaaaggtattagtaaacttcaacaacacttaggtggtgcacctttatctgatgattccaccagcttccttttttccttcagtttagagaagtttctacttgaaggagcatgcagattctttgagggctttgacataccagttagtcagcgattgactcccagcttctgtactcatacttgtgctttcgtaaaagctgagtgaatcacctttttaaaaagaaaatagagaaagtatgtaatcgtgagagcaacgatggtatgcctggctgtgatggtgacggcccacgccctaccaattgttacatgaatgattactagtgctaagggcacacattggcatctatatatatctctgtcctataatagtatagctggttcactagaaaagtgcttagcctatttatcactgtcgctgcaccagcttaggtagcttcacgtcagcgttctggctttagtcacttgagttttttttattttgcatgcaatat

SEQ ID NO: 313 - DNA, 390 bp, Zea mays
tgtattccagcctgtagtactgtaatactgttgttgaatggctccctgcatgtagaatgaagccaaccataccttctctggctcaagggtgcatccaatgcaacgcggaagaactgctcgtagcggtggagccatgataacgggtctttggagccgtcgtacttggggaaacacagcttgtgagtggcggtgttgatgaaggcgctggtcctaccatcggccgtagaggatttcggctggaacacgggctggtgctgctcacatggcttcttgtagctgcccaccattgcttcggctggacattgttgacagtgatgtggagacaaccctgatcagccttgagggagacctcagtggacaggccggtcaccttatcctccatgtccatca

SEQ ID NO: 314 - DNA, 518 bp, Zea mays
tggtgggtcatcgtcgcggcccagttcgggtacatcgtcaccagcgcccggtgcagggacacctggacgggattcaccacgcaggccttctcgggcctcggcaccttcttcaagctctcggcagcgtccgccgtcatgctgtgcttggagacttggtacttccagatcatcgtgctcatcgccggcctgctcaagaacccggagctctccctcgactccctctccatatggtaggagcgtctgcgtctctctttgtgtgtgtgtgtgttgttcaccagcgctactagctttttaatttcatcatcggtctctgttccgtctttcgcccgcagcatgaacgtgaacgcatgggtgttcatgatctccgtcgggttcaacgccgcggcgagcgtgcgggtcgggaacgagctcggcgcaggcaacccgagggcggcggcgttctcggtgttcatggtgacgtcgctgtcgttcatcgcggcgacggtgtgtgccgtcgtcgtgctgtgcctccgcgacca

SEQ ID NO: 315 - DNA, 510 bp, Zea mays
tgcccagctcgtcgatcgcagccagcaacagcaacagccagcaagctaagattcatcatggcttacgaaatctctcggcctccataaatcacccatcgcaagcatgctctagcattagcattaccttgcccccgaaacgccagggcggccatcgaaacgcgagagccattcgaggataggtggaggcagcagtggcaaggaacgcgagggcaacaagaaactgcggctagcgatggcggacacgccgtcgccgtcgccgacggcggccgccggggcggagccggggtccgcgtcgacgccgctgctgcggcggaggggctcgtacacgcggaccgtgtcgcacgcgcgcgacgagctcagcagtttccgctccggcctgcggtggatgtgcgtcgaccactcggacgcctccagccccgccgtgtcctggctcgtcttcgccgcgctcggcgtggccgtccccgccgccgcgcacgcggcggcggcgccgcggcgcgcctacgacacgca

SEQ ID NO: 316 - DNA, 481 bp, Zea mays
tggttcagagtaactgaaaagcctatatcagaaaatatgcccccactaaatgcattatcagcaacatcaattatcacagcattaggcaatccccacaagccagcaggaatactcccactgaattgattttgacttattctgaacctctgaagtgtcttgcaagaagagtaagaagcggggaattcacctgaaaagttgttggtcaaagccaataagaactggagcttgttgttttggcacaagaatcttggaaattcgccagaaaagtaattctcggatatgtcgattgtgttgagtggtgagaatcgacccaggttggcagggaactttcctgagaactgattttcataggttgagaatgactcaagaaactgcaggttccccaactcttcaggaagttcaccaaagaagttgttgtggtatatatggaatatcctcagcttcttcaggctgccaatctccttaggcagcatgccagtca

SEQ ID NO: 317 - DNA, 491 bp, Zea mays
tgatgaacagaaccagtagtaagcactgaacagtaagatgtcccacattgccaataagtctgccagcttgaaatctgaatgaagaggccagtgctatatatgtttgaaacagatatagatctgacaccagcatgatggtaccatgaatttgacaaagtcactaaattgctgagcttagatgaccaatctcgtctatgcaccccatcgtgctaatgccctattacaaacataagaaacgccaatattctcaaggacaaacctttggttgctgaggattaaagcataatgaactatttaacaaacataactcgtatcagtaccgatcctactaacccagtcaatcgcaatcagattggatctgatactgatcgccttttgatgaaagtgttacgactccacactatctagttatctgcattgttcatggaaattccacacagcaatggccatctgcatccataccagcaaaccagaacttttatctgccctca

SEQ ID NO: 318 - DNA, 579 bp, Zea mays
caggtcgctctagaggatccccctggaaggacatccatcgccacgccgacgtcaactgttctccatcaactggaagggaagtccagcaaaggtcccttttaatgttattgcagaccattccattgaaatgtataaatccagctttcttgtttgttttatagcatattttaccatatttatgtgaatggcggggcaggcccctacatgtatttctagcaatcaagcagtttcctaattttgcatctatgttttttttatcattttaactaattttattcccatttatatcttgcttatacaacatccagttttcttttctaggactagaatagattgatgtgaaggggaaagaatagaaggagaagcttaacttgtatattaagaggaaagatagaacagtgtacaacagagcatcaactgatttgtggaacaattttgtcttcattgtaatcttcttcgtcattgcataatctgtagatgttgtaagcgtagttaaactttattccatgcccaagttgttgcttatgtcgttaagttcttgagaaactcaactgattagattgaaattatgcggattgt

SEQ ID NO: 319 - DNA, 475 bp, Zea mays
tgctcttgctacttttccatcttctgtaactccataagcaatgcatccagtgcccgcaattaacacacaaccatgcagctttcccattgtaccactagccagggccgccactgcatcattttctacataaatttttgcattgtctgggaacagatccctggagaacaaacaaggttcacttagcagatatacaagaaaatgatgacttactatcagttctgcatttctggctgtcagcatgttctgatttgtaatgacatacacaaaagcagcatcattctgacaatccagagcatcagggatgtccaaatgaataggcccaaacatttgagcatcatgatatcagcatttgttcaattgaaatgaagtggttgctgtggagcacaacaatgcaacccttccctttaggtgcaatactaaaatgcattttaattaacacagagaaaactataccggatccattccagcatcctca

SEQ ID NO: 320 - DNA, 497 bp, Zea mays
tgcggccattggtactgccctgtagcaggcccgctttgctgcccgcacaatgtcatcgacctgcaagcaagcacagccgtataaccaacaataacaaaatcaatggggctaaagtaatagtaatacatggcagcaaatcagggaagtttgcaatgtatgcacatatgtgttcatgcagacatgtttaaaaagtaaggtatagcagtgtagcaaaaaaaattatattagttgtccatgagcaacccaaaaaatgttacttaattatctcccgaatgagtcattccactaccaaacaagatacacacccaattcttactagtttccagtcttctgcatagcatcaagcattacagccaagctaccaacctataataccgacattatgctgtgtgaccactttgaccacaatggctacctggtatgcacaagcacaactggacagacaaagaaaccaccatactcctaaacatggcaggacaatcctccaggtatatcca

SEQ ID NO: 321 - DNA, 516 bp, Zea mays
tgcctttctaatgtcaaagttctgctccttgcgctctccctaaacaagcacgaagtatcaagcacaaaagtctatatctagaacaaagcatatgatttaaaaccatcagatgccagccagatataagttacctggacatagatatcgaaaaccctcctccctcagcttctccaagactgcatgtctggaaagtcaacctctgcaaattgaagtgtgaccgtgtaatttccattctcaagtccaatgccatagtatctcagggatgatggtgacatccttgctgtttggaacagtgcagagtctagggtgttctcgaactggcgtgaactgtagatgatgtaacttgcattgggtgcatctgcgtccaagaataacccaacgctgctaacggcccatgtaggtgcacccgcaacatagtatgatgcagcactaaggttggcattatcagcttgatagacagaattatctgaacctgatattgctctactaccaccacagtccaccgcaaaggacgca

SEQ ID NO: 322 - DNA, 497 bp, Zea mays
tgaggagagagcttggtgtaagtgaggaatgggtgtatgtactgaccaaggctgaggcatacaagctccattggtatgccctggatccagtgtttcagaaatggcagaggttgccaccgatgccttctttcgtcaatcaggaggaatccaatcggacagcatcttcggcgttctggatgtggaatgttgtgggatcaagcattaggattgctgattacgtgaggggcttattttggcgcaggaacagtttggaccagatgcccttttgcggttgttcagtgggtgttgctgatggttacttgtatgtcattggcggtttttccaaagctgttgccctgaatcgcgtttgtagatacgacccttttctcaatttgtggcaggaagtgagcccaatgatgactgggcgggctttctgcaaggcggcatttttgaatggcaagttatatgtagttggtggagtcagcaggggtcggaatggcttgcttcccctgcgttca

SEQ ID NO: 323 - DNA, 488 bp, Zea mays
tgtcatgggtacaaaaaggctcccatttcccagtagggtgtttgatgttgttcattgtgcacgatgtagggtaccgtggcatattgaaggtactttctatcatgagaatcctgctctagcacaatacagtccctttgtgttagctgcttctgtgacactatgcctgttagttatttggcaggcggtaaactcttgcttgaactggacagactgttacgtcctggtggttactttgtgtggtctgctacacccgtataccagaagctgcctgaagatgttgagatatggcaaggtattccatgctttaatttcttctctacagttattacagtgaattacgaatttcatgccccaagagttatctttgttctgccttgctgtagccatgtctgctctaaccagttcaatgtgctggaaaatggtcaacaaagtaaaggatagggtgaatagagtgggtatagcaatttacagaaagccaacagacaaca

SEQ ID NO: 324 - DNA, 728 bp, Zea mays
tgctcctgccgtcgccgtggctgaaatccgaatggcaatcccagcagaagcatcaaactgagcagcatgatcaaaggcggaactcggaacggctgctatgtatgattcgagacgtacgtacgtgatgggttatgttgcgacgttatgaagcgtgccacggtctgcaagaggcgaagagcagcaggtgcaggtcgcggggtgcgtccgatgcgatcccgatctgctagctgccgcacgtcaaatcgagaatggatctggggtggggggtcggtcttcggagtaacgcgacgatcgatgcatggcacgagagcggggggagacgagatggccgcgcgcgcgggcgcagtatacgtaccacgaacgcgtagccggtgacggtggcccaggagttgccgagcgtggcgccggcgaggtggacgtcgccgagctggcccgagaacatcaccgacaccagcgggatgccgtagtaggccatgctggtcagcaccatcggcaccgcgaaccccagggatcaacagaaatggatgagtgtactgtgtgtacagactacagagcagacgaaaacctgaacaagagtaagtatcacttgaagcaaatttaacctcttaacgcatggggaaggagacttccatatatttctccatcccaaacaccacgtggatgtcaataaggcatagggtcgggttcctatgaatttctttcaaaaatcgtcctgtccggaggagagc

SEQ ID NO: 325 - DNA, 635 bp, Zea mays
ttggtttgggaagaaaccagcacgcatccgtcgctgtcaggagctgatcagatcggctgctggagttaagacggacggacggcgtattatggacggggaagattcctgatgagatggcgacaccaaaactgaaagccacgggcctggatcctcttctctctctctctctgtctctctcgattttctcccggattttcatattactattctctactagggatggatggtgtatgtacacaccgatacaatcaaggaccgtatcagcaggttgaataataacaacgataataatctactgacacgcgcaagtattttggggctaatcatcggggtggatgctgcatgccgacgaggagatcgagggggaatcggactcgtcgtcgtagtcgtcctcgtcgaagtcgtcgagatcgtcgaagtcccacagctcgtcttgctcctcctcctcgggcatctgccactgctcttgagaaatctcgccggactccagtagctccaccacctgcccattggtggccatgtgaatccagtcagttaagtaccaacagtgccaaatttaataaacagcactggagcttcaattgaccggtccagccgtccaggtccaggaccaggagtaacctctgccaacagca

SEQ ID NO: 326 - DNA, 604 bp, Zea mays
tgcacaggccttaccctcagcgactacaggagatatagcaccagcttctgaaggaactgtttttgcattatgaactggagctgtttcaatttccatcatatcagcacttttgacatcatcatactgcaccacaggtaccttaggagaaccaatgagctcccctggttcttttatcatatcagatgtatcacagatctccacacttccaggaaccttggatgtcccactagagggtgaaagattttctgtatgtgtcacccctgtgggagaaccttcaagagtagttgcagcctcagtattcacagatttaagttcgccttccaatgaatcaatctcgagttcagtcttttcaatctccttggaaatgctttccttcagtaggagcagcttatatgtactggtcgggccatttgaatccccagaacaagaatcctcgtgctggataagttcaacaagcatgtttccaagggaaataacaggatcatcaccgagctgatctaacttgatcggaaattcattattgaaagttgtgtcatcagcctccaagacatctttagtagagttagtgaccgcatttggcatcatttcacaagatttatcttca

SEQ ID NO: 327 - DNA, 721 bp, Zea mays
cgagatccccctgccaccttctctgcctccctgcgtcccccgagcaaagcagaacaaggggggaaaaagttgacatacgcttgcagcgatggttccttgccgcccgcgccgcgctcgtgcgcgtcctccctccgcgaccatcgccgacctcccaaccgaagcagctcaagcaaggtacgtttcgccgccccgctcccactgttcgggtcccgctcgaaatgccgcgacacagagctaaaaccctagtttcggttttgcaccccaaggtctaggcggccgcggcgggtcctcgctcgccgttcgggcgaaggactccgatgacttcggggcccttctgtcggagaagctcgatgcgcaggcgcctgagaagcgggatgggcgggatggttttgggagggaggcgagtagcgtggaggaggagaaggaggtggtggaggtgcagggcgagccggcttcgtggggtgtgctcaaccagatcggcgtcgaggtgagcgcgcgcatccgattgcttttaaacttgtcgtgttgccgtttcaaaatgtgtgtgctggattgaggtgaaaatgttttgtacttttgtgtgctcgacattttgttactgaaacaagaggaaacctgctctcttcattcagtaccttggttcagagaacaaggtttgtagatatcgcgtcagtattcaaatgattgcaaacctacagggggatcctctagagtcgtgccg

SEQ ID NO: 328 - DNA, 591 bp, Zea mays
gctggtacccctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccgatcaatccgttgtggccttgcaccgcatcgggatttcatccgtcatcaagctcctgactgtgaagtaggggtccaagggggagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgca

SEQ ID NO: 329 - DNA, 608 bp, Zea mays
ggggggcttgctgcttcctgcagccgtctctagaggatccccctgatagtcatagaagggagctaagagcttgttcttggctgcttgaccgattcttgattgagctgctgcggatcttggcaaagggccaagagcttgctgtgtctggaattcttggtcagccgtgccggatagggtgagggtgccatgacagcatcgcagtcctcgatgagcggcggcggggagccggggatgcggacggtggtctggttcaggcgagacctgcgtgtggaggacaacccggcgctgtcggcggccgcgcggacgggcggggaggtcgtgccggcgtacgtgtggtcgccagaggaggacgggccctactaccccggcagggtgtcccggtggtggctcagccaaagcctgaagcacctggacgcctcgctccgccggctcggcgccggccgcctcgtcacccgccgctccagcgacgcagtcgtcgcgctggtcgacctagtccgcagcaccggcgccacccacctctttttcaaccgactctacggttcgatcccccctctctctctctctctgctctgctctaggtgttgttttacgccttgttacatgttgca

SEQ ID NO: 330 - DNA, 678 bp, Zea mays
gcgtttcccacaggccacaccaatgcactccaaacctggtccggacaaccgtacgcgcgtcatggaaagaaaaaaaaacacacaatgcacatctgtagatcatgtcccattggtgatgttctgactgtcgtaagggtagcagtagcggtaaatgcagaaattatagtggcttaagcatatacgaaaatacactgatcctagcaagaagcactcaacaaaccgacggaaatagaagccatgaaagtaaacttccatttagagtaatgcgtaggcgaatacaaagacagcatcgctttttttttacaggagcaaagaatagggcatgaacaaaacagaaaatgggaaatgctgtaggaatatggatgaattgatcattgtcatatacggagtacatactagtattccaaagagagtcaaagctgccacagcaactgagattacagggggtggtggtactacatataacattaccagccgttcattaagcttacaacatcatgaacataaaaaagcatccacaatcctggcaatgccagcgagaaatcgaatggacataaccttaataaaacagaggttcatgacttagagcaaggatcacgatatagttaccatgatataggaggaacagaatagaacagccgacgaacaacccagacaattgaagcatgaactcttcaa

SEQ ID NO: 331 - DNA, 462 bp, Zea mays
tgcagatctttctctgtgttcttgtcgatgttgacgctgaggactaggcttctccggcagatgaactggagctctggtgttgcgttgtggaagcctgctatcttcacaatatctcccagtctgtatcggtatagaccttcacagcccaatagcccatatcaaaaagcaagaacattaaacatgtgccatttcgatggagaaacatacaaacttccatgcaaaatcatgaattggaactgcagtgcttgaatcctactggagaaacagataatgtatgtacctgcaaaatttgttattacaacttcgtagattttgccaacctcaacctcagttaggcctacaggctccgactctatgtagtgaacagaggaacagatctccgtttcctcccattttggtttttccagaggaatgaactcgaaataagcaatgttaggaagaacagcgtacgtcacctcctca

SEQ ID NO: 332 - DNA, 474 bp, Zea mays
ggccccctgaaaaaccatgtaaacattgatttcatcaatttggattgtcggctagagacctccccaacacttatcaatttaaaacagaacatttacacatgatgtctctggttatttttttaaatgttttccatcgcctatttggtcaacatttcatacaaaggaagcagtgccgtgttgatcatgactgaactatgtgaattgtttaattttggtagcaaagggtaatctgttagtgctcagtccagaaattggagcatccatgtgctcatttgagatttttaccgtagcacttctatacgaataaaaaataaataagtgattcccaatgtacgactcatgtaattttatttgaagtttgtttgcatccatttaattctctgcttataagttcttgttattttcaattgaacatctcttaagtgtaccttgaagttaatacccttgtaaaacaatccagcaactctcaactca

SEQ ID NO: 333 - DNA, 450 bp, Zea mays
tgaaacgatagctttatttatatcactattggtacagttagatagaaaagtttcaggcctcaatcctaagtaaccgaccccttacatatttcgaacttctatttacaggcctaggcaacaacaagctacctatagtgcaccggcagagcccatgctcgccgttgcacgggctgccgtccctaacggcggcagatgtcttgcgtcgtgacacctcccgcatccggcgccgcttcgcctcacaatcgtccgtggtggcttcttttgcgtcggccccggccccggcgccggcagccaccataatccccctagacggctcaccggacgcgggcgcgctggactacaccgtgaacgtcggctatggcacgccggagcagcagttcccgatgttcctggacaccatcttcggcgtgtccctggtcttgtgcaagccgtgcgccccaggttccagca

SEQ ID NO: 334 - DNA, 557 bp, Zea mays
tgctgctgctgttgctgcccgtgcccgcggcagcgcaggcgtccgggcgctcgcacagcgggtggccgcacggcactgtcttgctcgtggacgactggctcgggctgtacgtccggtccgtcgtggcgttgccggtctccgcacactgcttgcattcgcagggcagccagaagaggtcgctgccggtgtccagcgccaccaggaacttggagctcggcgtgcccacctccacctccgcgtagtgcaagctgcgaacgagattccattattattacatgtagcaacaaccaacaagagggcaagatgcttgagcgatcaatcaatggtggcacggcaggcgcgcgactacgcgaaagcaaaggagggatcagcacgtactattcgtaggtgtcgaggtgagtggcattgccgtcggcgaaggtgagggtgctctggcggccgtcggcgttggcgaggccacggcggcggcgggcggagagggcacggtcgtcgtggcggagcagcgcggagtagtactccggagagccttgcggtactgcctcctcaggcaacgacca

SEQ ID NO: 335 - DNA, 509 bp, Zea mays
tgcatgcagatgttatcaagtatggttttaataacaatttgtttgtggcatcatctcttgtggatgtttatgcaaggtgtgggcagattgagaaagcctatctagtatttgctgacatgaaacacaagaatgttgtcctgtggaacgcaatgataactagttttactaggcatggtaaatctttggaagcaatgattctctttgagaaaatgcagcagtcagggatatctccaaatgaagttacttatgtctccatgatgtcggtgtgtggtcatgcaggtttagttgaagaggcccgatgctactttgatctgctggttactgatcagactgttaaacctaatattgttcactattcttgcatggttgatgttttggggcgatctgggaagactgatgaggcttgggaactgattcaacaaatgccatttgaaccaactccttctatgtggggatctttgcttggttcatgccgtaagtacaggaatgtcggaatagccagactagca

SEQ ID NO: 336 - DNA, 560 bp, Zea mays
tgctccttagtgattccgatgactgccagagagcaagcatgcattcagatattagaacatgctctaacatgacacaacccacatagaaaacaaaaaaaaactatgtcaggcttacatttctcctgctcctgcgctcgccagccgatgttctgctccttattgactcagatgactgtcagagagcaagaatgcattcggatatgagaatatgctccaccatgaccaaaccagaatagaaactagatttatgcaatgcttacgtttcgcctgctcctgccctcgccagccgatgtcctgctgtcccaggtcaacctaaaatgagtgacaaactgtgatcagaaatttgcaatcgagcgaaaatcataaagcacctccttctgcttgtttgtcgacatcaaccaacctgacggtgtttccatctagcgaagagcagagtctatcagaccctgcattctggaaatcagccgaagagaataccgacaatggtgggaaccccagattactctcagactcctccttccacagggggatccctctagagtcgactgcaggcagcagtc

SEQ ID NO: 337 - DNA, 485 bp, Zea mays
tgtgtttatgttacatgttccaatcgagccccactcatacctttttcctaaaatgtttgataagggctcattggatttaccacctccttagtgtggggccttgagtaggatgattaacttccctactttattgccctagagattggtcagccagttatgctagggctccatgtttgacttttttgtttctttttttatgacaccaacagattgtatgggatgaattgagccaggggtcagtcaatgtgattcagtttttcttctgaattatttttcttttaagaaggacagaccatgtacaatggtgagaactctcactgagtctcaccaggtcatgggtttgcagccgcctctccgcattttgatggggaaggcttgcctcggtttatccctttttcccgaccctactagtgtgggagcctccagcactgtatctatcatttttatttttatttttaaacaaattgtccatatgtgtaacagca

SEQ ID NO: 338 - DNA, 466 bp, Zea mays
tgacgcgctcattatatatccccattgttggattatgtacatgatggatgtcaataatatcatagtgggctacactattttacttgtggataaaacgttagcttctgccagctccgtaagcaagtgtggcaagcgtttgtgcgcctagtctttcattcctaataaccaccctgcttctgctcctgcccatagctattctctctcttgcttgcttgctgtgttgcctttgcctgccttggcctgagactgtaagacttcctgctgtaaggaaccaagcatcagcaagccagtcagtttccatgccctcccttttcgttcttagccatcctgatcccatgctaatatgcaatgcaacaaacagggaggacactacattttgtgccacaagctgctcattgttgtttttatttcttttttgtaaagatcgacactacatacacctcttgtacaacaacattctcagtca

SEQ ID NO: 339 - DNA, 551 bp, Zea mays
tgtattcaagcttctgtacaatggtcaacctgcttgcttggcacaatctcctcagttgcacaagcagatggctctatgtggtggttttgaacgagtatttgaggttggccctgtgtttagagcagaaaattcaaacacacacaggcatctctgtgagtttgttggtcttgatgctgaaatggagattaaggagcattattttgaggtaagtttgtaagaagaattcaatatttaattgtctgaagcagtcattattaattacaacttatacacaggtctgtgacattatagatggcttatttgtatcaatatttaaacacttgactgaaaactgcaataaagaactcgagacgataaacaggcagtatccatttgaacctctgaaggtaagcattcttgcttgtttgtaatttgagtatttgactatgcagttctatggttctgtagcctaagagattgacagatcacttataatgttatgcagtatctagacaaaacattgaagctcacttatgaagaaggagttcaaatgttgaaggtacaaacttgca

SEQ ID NO: 340 - DNA, 503 bp, Zea mays
tggtggcagattttgcacacgtacgaaccgatccacaccgccaccgcggacccgggccgggtccgcactgtcattttcagtcattttcagtggtcaacacgtggttttagggtctcaaggttgaactattgcaaagaaccaaagaacaattgtcattctgctcttgcacagatgcgcgaacggctccatcctccaggcacaaagtcatggccaggacccaggtacaagcattaggcaaggtaaatgaccggtcagtcagcactgaagcatacagccaaatgggagctccaggctgtacaaaatctaagcacctcaaacaatttgaagttcacctagacaccacgctaacagagcgacattattatttctaacaacccacatgaatacatgctaagtctcagggttcgctcttggcagcatggctgtctgatgcacctgcgttctgagcatgtgatgacagagaaaatcctctcatctttaggtccaccggaaatggatgcgcc

SEQ ID NO: 341 - DNA, 480 bp, Zea mays
tgtttggtactcctacttcggtgtagtttgatctttgacgatattccgagccttagagctactaatactaaagctaaattcatgcactttaggggcatgttcgaaaactagttatgggtgaaatccggccttttggtgcttatttaagatattttgctgctgtcagattctgcttgtgaaacacatcgaggacgtactcgaccatgctttcgaaggcggatgtccacttaaatcacgctccaagttatagcatccaactcgcctttgctatggatatttgcttcggaggatcatcgtcaacagtaccacgaatgatcaacagtcagaataagagcctagctctcttgccagcacaggtcttgacacgcccattttggttaggcttcgcatctgaatgtgtatactggtcagaattcggagagcagtcagaagatctgctcgttcacctgctgggactcattgcatagtttctcgacacca

SEQ ID NO: 342 - DNA, 462 bp, Zea mays
tgttcctcgccgtcacctacgccggagccatcatcgcccctctcaactaccgctgggtgcgtgcgtgcgtgctcctccacttcatctccttttctcggttcttacagcacacagcactcactccggcaaagagtgcaagtaagtttcgtcgtcgtctccccctgttgtgaagcagagcttcgaggaggcggcgcaggcggtggagctcgtgcggccgacggcgttcgccttcgacggcgcgttcagctcctgggcgcttcggctgatggagggtgacaggttcccatccatcggcctctacctcctcctgggcgatccttgcaggaccggccgcgctgctgcaggttgtggtgaggttcttgcttgcgttgcatgcgtgggcattacaagagactctctgcacgcacctagcacttgcaatttacacacgcttgctattttcttggacacatgttgggttca

SEQ ID NO: 343 - DNA, 471 bp, Zea mays
tgcgcgcaccggtcgcgccaccggcgtcgcagctcgtcagcctcccgcgccttctcctgaaaaagaaggcgatagtttccacgtgtgtcagatcgtacgctgcagccacgcacgacaaataggagttgtgggacgtgtgcgtgtgcgcgacacgacgtgctgcgactgcaacaacgataactaattaaccgacctgcgcgcggtcggccgggcgtccgctgctcggcgtcccgatctgcagccactgcgacatcggctgctcggccggacagggagcacgctcggatgaagccatctcggcgcgctcgcgctcgtagccctctgcgcaggcgctgcaaaggctcggcgcccgttgcattggggacgtcatcgccgttgacagcacctccacagagctgctcaggatgcccctgttaactccagcactgtcacatcaggaaaacaaacaaacataggaggattcagtgagca

SEQ ID NO: 344 - DNA, 587 bp, Zea mays
attcgagctcggtacccctgcctgcaccggtcaccggcctcgaacgcctcgaggcagaccgcgcagtccccggtctcttctccgtctgcggcagccttgaagtactcatggcaaggaagcgtagcgagctcgccgctggacagtccccggcggccgcggccgtcctctacgcggtcctcctggttggcggcgtgctggctgctgccgcgggagccgagcccccgcagcagagcccagaaaacgacgaggatgtgggcgacgagcatcacagcgacgcccgcgatgagcagcaccacggagaggatcgcggttgggttggtcgtcgtcatgctgttgctatggtagcgcgttgtagctagctagtgatgaatcatgtaactaagggtcgtgtttctcatcgatcatgtgaagatttctcttgcttttgacgttccttggtttggatttggatacatatgtagaccagttctagtacatgtgttgggagaaaccaaagaagtgtggcgacgacctcttattgtcatttcagcactgtacgtaggggatgtgcgtagctgcgagtcactgatagctacaagcaagaaaac

SEQ ID NO: 345 - DNA, 435 bp, Zea mays
tgctaaccagacttggttttctgaggacctgatccttaactctatctttgaactgggagtcccgatcatgggtgtaagaatgacgccatcaacttttcttttggtcatttgttttagggtaagtatccgtggtacacttggtataatactggctgtcattgtcacaacttgttctctccttgcactacgcaccaacttatcctgctttttccctacttgacatgtattggtttgtcattcagttgatcaaaccgagcctgattgggattgcattctccggtgatacttacatgcgttcatgtccccatcacagccatctgtacatagttttatggtctctgtcacccatcttcagccaagacgagagaggtaggggggaagtttcttgccctccgcgttgatcaagcaaagagtagaaggaaacgctctttgcag

SEQ ID NO: 346 - DNA, 497 bp, Zea mays
ctacttcgagctcggtacccctgggaaacctgcttctgcaatcgctcattctcctccatgagaagcttgttcattgcagtcaactttctgttcacggactggagcctcgaagactcattgcgttgcttgtcacggcacctaacaccatgaaagaatgggcacagaattcagctagagcggacaaatcagaatcagcattgctatagtaaagggctggcgaaaatcaagaagacgaactacgttttggccatttgctcagaatagcatggaacagactttcaggtttgcacgacatcattacgatgtttctacggctattcgttttaccaatcacatcattacgatgtagaaacaaaaggattcatcgagattcacttcctcgaggataagctccaacagatttgctgactaatttgtcagcgctcacctccggttctggaaccagactttaatctgcttggcctcgatgtttgagaggatggggcactcgcgtagca

SEQ ID NO: 347 - DNA, 502 bp, Zea mays
tgttccaaattcttttccagggctcaaaggattccgctccaatgaaaaaagctctgtaggcatctactagacagaatactcaaaacagtcttgcgtttccttatatcgacatctatcttactaatgtttacagggagctatccttgatattttagaacagttttactgtaatttgaaagcagcaattaccttattcatttataccaaactgccaataaggtccattgtcaactgatggatagagtatttaaggctttacttatttctggacaaagtgttttgttactataacaaaagtaaccagtgaggaatttgcatttaattttctgtccaacgcttattatgcatgcaactctatgtttatatagcaccaaaccaccaatgttaattgaagaattaatatcgattctaagtggatgcctgtttcctcatttactttattcattacaaacgttgattgaagaatttctgtaaatactgaatttttattcccttttctgtg

SEQ ID NO: 348 - DNA, 467 bp, Zea mays
tgcttgtagacacacaaaaggttcccagtcctgagtaacaataacttcactcctatgaatcaagaatctttttgtgcttcgacttaaggacatagagatgaaacttacaatcttttttaccgctaactaaagatgagtatacaaaattattttttgtggaaaatctaatcctactgttttcacctgaccaattaaaacatttgaaatatactccctccgttcttttttatttatcgtgttttagttcaaaaatgaactagcaggcgacaaatattcgagaacggaggtagtacatgtttgtgcacaaattgatacctcaaacttccacttatagctcagattggcctcccaacaggacgtgtgtgtgggtggcttatgaagacatacagttctccagtatgttcaagaatagaaatggctcctcgaaatttaaaaaggaaagttggttcctgtatcttgggaaatgg

SEQ ID NO: 349 - DNA, 551 bp, Zea mays
tgctggccctgctgcgcaccggtgaagttgaactcgggcgtcttcatcttccgggcactgctgccactggcattggcggccgttgatggatcatgctgctgaccttcgacgccaccaccgcctccggctttatttgagcgtggataccctgcgtagtttattcccattaattccaaccagccgcgcactatattatctaactgtcagctttttcgatcgagagattaaagaagctgtgtcaacttgccaagatggttaatgcatggactgaaccagtgggcaactagctaatataatttacaaacttgactgtccatttggtagctctcttcctgatgacgaagaagaaatctgacgctagctcttgtcgaactaatttaaacacggagatcagaataacggaagacgtcggccaaactacacaagatccggcggtgtggccgttaggaggaggagcgcacaaagtgccaagacactttgcaacttgcatatataggctactgtttttagcaagagtgcaagacggcggtgacgtcacggtggagccgtca

SEQ ID NO: 350 - DNA, 558 bp, Zea mays
tgcacatgcagttttagccgctcctttctcatgatcaactaccacatgtgacacacgcgcttgtatattttagatgcggaatcgctgaactctgtactaggtgagcttcgctgatgctaagtttctagctgtgtcccaaacctgtttactcaggctgtggattctgcttcacctcccaatcctttgacatctgctccgaagcaaagtcagagcgctgcaatgcaaaacggaacgagtgggggcagcagcgcgagcaccgccgcgccggtgtccggacccaaagctgatcatccatcagctcctgtcaccaagagagaaatcgatgccagtgcggtgaagccagagcccgcaggtgatgatgctagaccggtggaaagcataggcatcgctgaaccggtggatgctaaggctgatgcagctccggctacagatgcggcggcgagtgctccttatgacagggaggataatgaacctggccctttggctgggcctaatgtgatgaacgtcgtcgtggtggcttctgaatgtgctcctttctgcaagacaggtaggttgcat

SEQ ID NO: 351 - DNA, 514 bp, Zea mays
tgcaaaactccaagctgtctgtgcagggaagaacagtggagtatagatacatgttcctcatgttctggatcatcatcattagtagtaacgcgcatgccattggtccccggaatgttccgtttttacttgaggggaaatggactcagatctccctcttccatcacgcatgtaccaggcatgcatcatcagctcatcttgcattaatattgctatatatataatccaactacagtatctatatctatatatgaatgatatatacactgcatgcatggctttcctctggatacgtggtatttcatgtgtatggatgctttcgcaatacccttgcttcaattctttttctctttttccttgtacacctttgtcactcagattccatctgctggatgagttcgacgatgctaagaagagctgcaggaaacgcctagcggaccacaaccgccgccgccggaagtcaaagccatcggatgctgatgccggagacaagaaaagggcacatgcgaacaaagca

SEQ ID NO: 352 - DNA, 558 bp, Zea mays
tgctcgggtccggcaacctcgtcgtgcgcgagaagagcagcagcgccgtcttccagtggcagtcgttcgaccatccgcagaacaccttgctcgccggcatgaggttcagcaagaacctaaagaccggcatggagtggtccctgacgtcgtggcgggcgcaggacgaccccgcgacgggggactaccgtcgtgtcatggacacgaggggcctgccggacatcgtcacttggcacgacaacgccaagaagtaccgcgcggggccgtggaacgggcattggttcagcggcgtgccggagatggactcagggtacaagctgttctccgtccagatggtggacggcccggacgaggtcacctacgtgctcaacaccacggccggcatccccttcacccgcgtggtgctggacgaggttggcaaggtgcgggtcctgatgtggctgccgaccagccgggtgtggaaggaatacccatggctgccgcgcgacgcctgcgacgagtacgcgtcctgcggcgcgttcggcctgtgcaacgtcgacgccgcgccgacgccgtcctgca

SEQ ID NO: 353 - DNA, 522 bp, Zea mays
tgagcagcggcaacgtgctctggcagtcgttcgaccacccgtcgaacaccttgctcgccggcatgagactcggcaaggacccgaagactggcgcggagtggtcgctcacgtcgtggcgcgcgccgaacgacccgacgaccggggactgccggcgtgtgatggacacgaggggcctcccggactgcgtctcctggcaaggcaacaccaagaagtaccggacggggccctggaacgggctgtggttcagcggcgtcccggagatggcgtcctactcgactctgttctccaaccaggtcgtcgtccgccccgacgagatcgcgtacgtcttcaacacctcggccgacgcgcccttctcccgcctcgtgctgaacgaggtcggcgtgctgcagcgcctagcgtgggaccccgccagccgggtctggaacgtcttcgcgcaggcgcccagggacgtctgcgacgactacgccatgtgcggcgcgttcggcctgtgcaacgtgaacacggcgtccacgctgttctgca

SEQ ID NO: 354 - DNA, 508 bp, Zea mays
tgagggcggatatgtacaaggtgtacgtgagtttactacactacctatattgcaatattatatagactggtagtcagagttgtaaattggtaatcatttgatgactaaaataaccattttttatatgctatggaaacaaacatctagctgattgttgagaacactgagatcctaccaggtttgaggtcacgatgaaagtagcccctctggtgcatgtatgcaagagcctgaaatatctgaaaacaccagttgcggacttcagactcggagaaaggcttgaccctttctttcataagttgatagagattacactcctataaaaacaagggttcagattcaagaacacaataatggtgcagtagaatatttgctatacataacatatttaccatgtattccattatgaagtataatatatcattttccctgataacctctttgagcttcacaatgttaggatgattcatgcgccgcaaagacttcaataaaataacaataaaagaatata

SEQ ID NO: 355 - DNA, 464 bp, Zea mays
tgcttcaggcttagcttgataagttctcgttctaaaacgaaaaagattctgatttgaattttttttattgaggtacatctttttttactcaataacaacttttaaaatagtctgggaacctcatggagcagagttcatgatttcaacatgtgaatgcccgtctgcaataatcataaaattctcttcaaaacagtaatcactataagcacacataaaaagtaggcattacaagaaacacacaagagaaactccaaagttctagaccatataatgcttgcactagttttgccaacaatataatgcaatagctagttaattgaagatgctaagactaacaagtgaggaagcaggtagctgccatacactttgggtggtaacatgatcttccacagaaattcttcagcatcccctaaatagactcttcgttcaagaagagttggaaagcctgcggtcaattgacagca

SEQ ID NO: 356 - DNA, 530 bp, Zea mays
tgtcacttctaacaacaggctaccaaacagtgtggcatataatgcaaggcagacacgcaccatttcaacgtacgaccataaaaccagacccagtgttctgacagagcagcactagcacactgctacgtgtgcagttaattaacggagctgttgggggtctgactgcaaaggtgcatccaacatcgtgctggaaccggagatccaagcagcaaatctgacgtactagagctcttatgaagtatgaacagcacctgaattagcgtatcatatctgacgaaaaccaaaaggtactgttacctgtctctccgcttgtaaatgaaatgaatggtggttctggtattttgatctctgtttcttggagggcgtgatagctttgcagttaggcaaggcaatcaccgggggatgatccagtgcgttgttctaaccaaaagggcagtaaacccaaccactcgctagaggtacaagaagttcaggttgcctaggcgttctgtcgcaactgccaacagcaaagggatctgttggtgactgca

SEQ ID NO: 357 - DNA, 489 bp, Zea mays
ctgagcacttgtcaatttggaaggccttgttgaagacaccagcatcaattgttctgattatctactgttttctttgtgtatggtttgtgggtggtttatctgtcttccatttgtacctgatgggcactaaccaggtaggtccaacattgattccagttcttttgtcattgatgctgcaaccgcagttcagtagcctaatccttcatccatttttccttgtagacaacatacgagaatttcaggtatcgctatgaccggcgcgataatccatataacagaggtactctgaacaattttctagagatattctgcaccgctatccccccttcgaagaacaatttccgggcaagggtgacagtagagcaagggctgcagcaaacgcgctcacagtctaggggtttcatgagccccagcatgggcaagccaaccattggagagcttgagatgggcaggaagccagtagtaccttgggacgagccaaggacggca

SEQ ID NO: 358 - DNA, 514 bp, Zea mays
tgatggatcctatgcagtcatcggtgagaggccgcaggtcttcgttgcatgctgatgctgtcataactattggaggagtgcgacctgcaccacccccacaaacatccacacaacatgtatgtcaagatgaggcaatggtcagcagcggggatccctcttggatgtctggttacaggtacgcaatccaggttcagcagtcaatcgagttggttggttcatgtacatccctatcggacaaaccaaatcccatgatccaactccatttgtttgtccagccaaaattcacaaactaaatctatagctccacaaccctaatgctagttagttcatgcatatatcactgtgtgcttttattaagactcatagtactattttggattaaccacggcatcaatggcagtgttccagccattgagttgcagtgattcagtttttgttttctacggcagagtatagcacactactaatccgaacatcgatgttggtggtgccagttgattagcactggtaactt

SEQ ID NO: 359 - DNA, 481 bp, Zea mays
tggaggcgagccgggccaccatcgattcgctgctcaccgacgggtccaagctgatggactcgttcagcctcgtggtgaaggagctcgaggagtcgcgtgccaaggtcaaggccctcgaggacgagatcgcggagacgtcgtcgagggccgcaggcgaccactgcagttgctcgggctcggagtcagaggcctccgagctgagggcggagctggaggccgcggaggccaggtaccaagaagagaagatccttagcaccgtcgagacgcagtgcgcgtacgagctcatggaccagataaagacagagtccgacctgcggcacggcaagctcgcggcggcgctcgagggcgccaagtccgaggtcatcttcctcaaggcgagtctgttcgacaaggaatccgagctacgtagtgccctggacgcgatcaagaagctacaagcggagacgagagcagacggctcggccgacgcgctgaagcagca

SEQ ID NO: 360 - DNA, 490 bp, Zea mays
tccgagctcggtacccctgaagctatagctgctgctgctggggagtggagagtgagtgagtgggaatcttctgcagcttctgcttcttctccttgcttgtgtacaaataaaaatcccaacttcaacttgtcatggcctccttttcagacttgttattatacctgacgtcctcgttggtgcctgggtcacatcacaccaccaacggggtgccattttgtgtaaaagaaatttacagtcacttattagcttgctaagattgttgacaaaatatatagtatttctttggaaaaaaaaaacagcagcaaaagtaactgacagaaacaggttggcaattagctagcaagctgctgctgctgatcatctgggagttcttttacggcctcgtcgacatgcaaccgcgatcgacgagaggtccgtccaccaccaattccattcttcttctcttctcatctctagcactagcacaaagattgcattgcattgcattgca

SEQ ID NO: 361 - DNA, 470 bp, Zea mays
aaaattatttgatgatagccctacttctgtatggttccttcttacatagtttttcccctttgtataataatcattgttcagatccaatcacttgttgacaaaatctcttatgaaactaaagtcaggtgacagtagcccagagagttctacaaattcaacaaaaaatgaaaataggaatgaaaaacacgaaacagctccaaaggaaaaaacatcaaagaagaaccggaagaaggagaaagaagtggcagagagtgttcctgtaaagcctaaaaaggaaaataggcctttggttctgccttttgaattatctgttatgggtattttattgctcatcgtattaggtggtttctatgtggtaagttctctgttgttagtcttaccagaatgaagacaatgaatgtcttcattgaatgaggtaatcttaatgttaatgattccatttttttaggtccattgtgtatgggcggcag

SEQ ID NO: 362 - DNA, 505 bp, Zea mays
tgttgaagaagcccaacgagccattaattccgcatatatagaggtaggctgatcatacttgctatgcaggctgttctgtagttgacattgtttagagatacaaaggtttatagaaagatgctgcatggagatgatctttgttttatttatgatgacactctttttaggcacgtagtgcttaccatggtattggcttggtcaaattaatgggaagaagcagcgggtttattgcaatgcacgcttccctttcaagtgggcaggtcgatgtctgcttaatacctgaggtaatataaatgtagcttttactatgtttaaaactgccatatgttttcctctcacatgtaagcgctaacagaagcttacaagttacaatatgaatgaaggtcccgttcactctagatggagaatttggtgttttgcggcaacttgagcatttgctaaagagtaagggattttgtgtggtttgtgttgcagaagctgctggacaagtatgctaaaattcaca

SEQ ID NO: 363 - DNA, 480 bp, Zea mays
atgattgattctggctgccaactgtaagcaatcaaacagaggggcaagtcaagcctgtaagtgaaaaacaacatggtaagatgagacagacaagagatgatttagttgagttaccctgctgctgtggagaagcggtagccgtagtgatgggttcaggatcctgcaagccaagcagaagagagcagacagagaggcggcgtaacgtatgataagaaggcacgggcatgggtggatgaagacggtgatggaaggaggatgcttcttcgtcttacagggactcttcgtagggcctcgtcgatctcctgtgtggtgaggcccttcttctcgaggaaggatcgtctgtagacgacgggggagcccctgacctttgggtgggagaggaacttgacggcgttctcgacgtagtcctccctcacgggctgcggctgcagcggcgtctcgaagacgagcttgttgtcgccggctcccgggtcagcatca

SEQ ID NO: 364 - DNA, 483 bp, Zea mays
ctgaactctatgatgtgaattccaaacaggacctaactctgtgatgtgaaattgaaatcaaagtgccgactgccaatggacaggactggtaaagagttttattgggatcccatctattttaggtagttgatcaaggttaagctgcactttggtgacccaagcagccctactaaatttggtaaatttggtggtagttaatgaatggcaagatcattgaactcaaaagcttatctcagacatgacaactcaaaagcttaccttgaacacgagtaccaatcagaatcggtacaagatggttacctagagagaactataaaacgactaaattaccacataaatagggaaacgcaccaccgaactgcactctactcaaggtaaagacagtagcagcatcatggaaaggttgccaaacatgcatcaggagccactcgcgaaccaaaaaccttttccccactccatgacacaaatcaagaaacggtaaca

SEQ ID NO: 365 - DNA, 566 bp, Zea mays
tgttttgtacaagtataatcgaggatctcgctgtaagattgctttgcgtgtcttgacaaaaagatttctcggccgggagatccagaacacaggatcggggcatgacagtgtggaagatgctagagctgctctagaacttgctatattgaaaataagacatggtaaggactaagaaggcatttttgctatcacttttgtttggctaacatccatttctgtaaatagctaatgtggatagggagacaacatggcataagcatatcattttgttggtactttctactaacttgttaaccaggtcctgattttggttcccaaccatcgttgtcaaggcggaaattgacatctatactgcatgagagtgggaaaaaatgctcccttattgatgacatgtctattctagagcgatattcagatacttcttgcaattcaattgctgtcttttctgatgatgatgccctctccagatcaatgaaggaggttggtgcaatgcatttgtaggtgtatgcattcttcccaaagtgttataagatgttttcataaccataggttgaaatcctactgca

SEQ ID NO: 366 - DNA, 493 bp, Zea mays
tgcaggcaggctgttagctgctctagtcaagatatgtgccggacatggacagcttcttcttggcaggggcgtttggaaggtgtgttctttcttcgttgtgctgtgtgtgccagtcctctcgtccgcgggcacatgccaagctgtgagcacgacctttttcagatgagaggtttctgtcggttcgtaggggatgccatgtgtgtggagccggccggcgcgcgacctaacgcgaaaaaagaacggagaaaagtggggagctaccatctggtggcgcggtctccatgattatgtcgacagttcaaccgcatgaactgcttagaaacaaagaaatgtaaacgtcatcatgtgctttgctaattcagccagtcctttttttgttttcgtttattttattttaaaacagtccttttttttgttttcgtttattttcgtgttaggacctgcacgttttcacctatatctttttttttctctctctctttgtatccctgca

SEQ ID NO: 367 - DNA, 544 bp, Zea mays
tgctgatgcaaaagaacatgagcctcccaacagtcatgtctataatgcagttaaacagtacaaccttgcagattttggtgagaccaattcagatgccacactttttattattaaatcatatactgaggatgatgttcacaagagcattaagtacaatgtgtgggtaagcacccctagcagaaattttaaaaaaaaaaacaactagacgctgtcaatttcctccgttgcctagagacttaagttagttccagttcttcgccgttcctttatcaatttcctccatatatagcccccgatcgatctgttgttgatagatctgaagaataaagaatgatacagttccataatgaagatttgttagtgctgaagaccaccggtgtctgatccttgatcgctactatggccaagcaataccatgcatgggtgaccatcatggaccgtgcaagaaatacttcaaagtgatgcaggcagcactggtaacgattcattgtttggcagttctggcgcgttcatcttagcgaaccacgggtgcctgagcgctgca

SEQ ID NO: 368 - DNA, 509 bp, Zea mays
tgagacacaattcacaacatgtaaattgcaataagtctgacaaaaggagaacatacaatgctgtgatgctgtaatttgatgtcgaaggaatgggggatgttggccctggcaagtttcttatcacgatatcaggatctcttaaaggagatacacttttgtatgatgaagttgcaatcttcatgtcgagaaaaatttaccgttaagaaatcatgaaggataccttgaaatatgatcacatgtcatattataataaactgtgctcatgttcgtagcttacatatacttaaatatatacatgcatatcttacatcattgtctaatacagaacacatgcagatttcataatggagcaactatttgacagtgttagtgccaaaaatcatatgcaggatgtggaagtcgtaccatgctatttttcccaccagttgaagtaggaaacatatcccttgtgatgccagacctagaactcctgattgtagcatggtcttttacaaaagggcgatccatca

SEQ ID NO: 369 - DNA, 510 bp, Zea mays
taattcgagctcggtacccctggtcgatgatacaattgcaaatcgcaacatcaggattgatccctttctcccacatctgtttgaacagcttcaccgcggcactaattctgccatttttggccaatgcgtttatgaacgtaccaaaggtgaataggtctcgttcaaccttagatgcaatgatatcattccaaatcctttgagcgtctctcaggcttcccttgacacaccaaccatttagtataatgttccagctctttgtgacatgcgggaactcatctttcttctcacggaacagcgcctccgcctcctcaacatgcttataccggcacagcgacatcattagtatctggaacccgaccaagtcaagctcaaacccgtaatccttcctcaagtagaacacctctatcgcctcctgcaccttgtgcgcaccagcgtaccggttcaacagcacggcaaacatcttattcgtcacgaccacctgacgtcgctcctcaggaatctcgtcaaaca

SEQ ID NO: 370 - DNA, 484 bp, Zea mays
tagtacgagcccggtacccctgaacattaaaactaaaacatccttttagtcttgtgtccaccgaaatcaattgagggtttgaggtaatgcatcagtcattgtctattgatcagcacaaaaagtaaggatgagctattatacccagaaaccttcaaattaagataaattgatattcccatagtaagcagttaagcgcaccctttgaccagtagttaaacaccagccactgacacaaagccagcaaaggagcacaaaataaccatacacgtgttgtaatactgatttaggtctcttttggttgagcttttttaacctgctttggtttttataaaagccaaatgttaatcaaaggtaggcttccacaggggcggaccactggtgtaagtactaacttttgaacttggcagttaaggatcgagtcttgatgatctttgttttttgtttctttttttgatatttttcctggcacactctaagtgtagca

SEQ ID NO: 371 - DNA, 436 bp, Zea mays
tgccaagataactgaagattctacatttgataatgatgtgttttctttccaaccccacttaggttctgaacaaacagggttctctactgcagaaaaggtgatttccttgattgttagtatctacctgtattttccctcctttttgcagtgcagtgttataatactatttggcttccctctattgccaacctcactacaaaatttcctctttttgtttttttggtacaaagcactttttaattgattcatgtgccagaaaaatgttttttatctacaggactatggtgcctatgagaaaaagcagtccttgtcgaatattcatcagcaggaatccagtcttcagtcaagctttaccgcagtcaaggataacactagtgcaacaattgttaaagcgaagccatcttctagttccatgttcagtgatagtcactattca

SEQ ID NO: 372 - DNA, 496 bp, Zea mays
tggggccctaggctcaagaaattctctgctgcattgcatgtctgcacctccaggtaggccagtacaagctccggcaagcaacaagaccactatctcctaccagcaagcagctacaatgcgcagtgccgcattgcaattgcaccacacaacctgcagagtatcaataccaaacagagacaaaaaaaaaagaaattgttatcattaacagttcaatctgcacagcggatgcaactgagccatccttcttactgttcaactttcatattcagcaaagccaacggaatcatttacatcctttacctcgttgacttcttaacaaatgaattatatctgagagatgactgcctcccacttaacaaattgggcaaacagccacccctgttctagcaccaattttgctgtacatgctaaagggatgcaatataaaataaaaaacaaaagaaacaatctccacctttcaccattctgattaaaatgacatgctatgaaatttaca

SEQ ID NO: 373 - DNA, 633 bp, Zea mays
tgctgaaaggtggcgctgttcgtcaggtccgtgaagagcggcgctctgaataccatctttccggcgtaggggtatgcgcagccgcagtttgcagggttcaggctctggtcactggaacacgaggccgtagaggagcacttggccaggctggtgttgtacgctatcattctctcctgcttgaggctgcagaagactttcaattctgggtccacgcagcccgggttccccagtagcctggatgcaggtttggcaagcaagaaatggaagtttgtttctcagttgtttgggtggagaaaagaagcagcttttatggatcttggggctgagtgtttcttacactagagtcttgttgtagcttggggtgacattggcagcagcaatgtcgttattcatgagattgatagcctgaagctgactgctgatgttgcctgtgacctcaagtgtcccgttgaacgcgttgttgctcagcacactgtctggtcagttacaaaaggaggtcaacgtgataaaaaatgagcacagcaccaaaactaagggcacgaaattaaaaacccttaaaaaataataattcttccttgtctaaacttattctttttagtttataaaagttgccagaacattacacttgctgca

SEQ ID NO: 374 - DNA, 659 bp, Zea mays
ttgaagcttttgtacaattaatacaaaagctaatctcccggtagattagccatctttaggtgcaagaagcccaacaagctttcatcactcttcgtgaattcgtcttggctgaggagtatcatcttgcccagcaaagtacaccatgacaaacagaagggcgatgacaaatataaggatgtacagcgagttcaggctgaccagagagttcaggaaacccatgaaagaagggccggtgattttcttctttgttgttcttcctgctctgtatccctcaaggaattggcttatttgagatgcttggtcaccttcttctaatctctctgaaccatccaccttcaccaggaaaattcaatacataaaataatgaattcttatttaatgattatcagagagacagtagcagtttctatcttaatcaactattaactttttcagggaattatgggggtaaacaaacaggaacctataaaagcaatacctccattgatagaaaaaccgtgccatcactagtaagaaacatgccagtaacgcagtggtttttatatggatgctggtattagaaaatatataattaactactgaggatgctttacttactagctcatactcctcatctctatcccacacaagtagctttggcaggggtaccgagctcgaat

SEQ ID NO: 375 - DNA, 632 bp, Zea mays
tgcagttctgtgcaacatacaaaatttttacgcttactcaccatgtagatatgtttttttagtactcagtgcaatagcctataatgtatttttttttccaacctagaaacttgtggctatttgacatactgaatatgtgaaaccatactgactatgcaaaactatagtttcttccttagataagtgcaaaaactaacttgatattgtttcctgtggggattattatttattcattctggctagaagtttggggaatatatagtcacagatctttgatgtaccataacctttttcattcgcttggtctggactctagaaaacttttgggcattttgtgaaggttgcctgcaggctaaacactctgtagggactgactgttagactgttgttttcttgtgttgttttcctgtctaaatgttatgggcctagagcccagcccatgtaatgtgatatatgggtttagggtttagggtttcacttctcgtaacagtgacgcctaatagggggcgggggaggtgaattatgggtatttgtttacttggcccagggtgcctgcatctgctgggctgggccaaggcaggatcggtcaggacttgccggtgcagggtctcttgtttggttgggtggaccag

SEQ ID NO: 376 - DNA, 626 bp, Zea mays
tcgagctcggtacccctgatatagatgacgaccgacaagttgggtaagtgcataacttacagctcatcctcagcatccctcttccatactagtcaatatatttttcctaaactgttccaaatgatactgatacttgaaattgatgtgtacagtgctgctgaatttgtactttacaagctaaaagagctgggcaagatcagccaagaggagatatcttgttttctcgaggagtttgacaagcttgatgttgaccagtctggcacactctcaacttacgaccttactctaggacaaacaattcaatgactgatgatgcatatgtgattttgctgactgaatgattttgtttgatgtcgttagcatttctgttgtccatatgtaacacgctataatgttgtaaagatgtaaattaagatgattgagaaattgtgccccaccttctctccaaagcaacttgaatcaaggctgtaaagaacaaatacttgctggagacagagacgacatacctgcaaatttatgattggtttagctctgcccctcatgccgtgtccgtgtttccagcatataatgtgaaaattgttatgtagttgtgatgaatactttgacttgttaccattggctctgca

SEQ ID NO: 377 - DNA, 683 bp, Zea mays
tgcatgcattttggacaccggaaacggaaagtcagaaccgtcctgtgactctctctgtcagtgataggacggtactatggccgatgggcatgggccgggtagccggcgggaggctgtgacctggaggacggcaatccagaagtgaccgtccgacccgagacggatgttgtccggccaccccggaaggtcgacgaacgtctctgcctcgccggccttatcccctttcagccacactttgatgcacctgaacctgcagcatgcgagcagtttattatgacgatccgagctccgagtgaaaggttcgttcgttcagttcacctcatggtctcgcagacgacgacgaaggcctcgtccctcggcagcgcaacgccgttggcgaagccgagtcggtcgagcacgacggacgtctcgccgctgcgcgggtcgtaccggagcaggcggccggtggagctgaactctaggaagtcgtggaaccacaaatcgaagccgaacctggtgctggcgtcgctgaagtagaccgtgccgtcggatgcctcgatcgccgcgtctgcgaacctggcggcggaacggccggccggcggcgcgcgcgcgcgcgcgagagagatcagaactgtcgatcactagcaactagcatgagagagagagagagagagagaatcaggggtaccgagaacgagtttgta

SEQ ID NO: 378 - DNA, 597 bp, Zea mays
tgccaggtaacggccacggattccatcactggaccgcctgtgtcctcgccaacagcaacccgcacgccggaaggggggttgcggacgccttcagattatcttcaaccattcctcctcctaaatcctacaatttatactttcagtttatatttaaataacacttccataactatatattattcatatgaacccaacaacaacgccgacgcctatataaacgtagttcacccacccaaagttgcgtgcagcagagcagcgtcgtatcgtattccatcctttgcttctattccacttcaaatcacaggcggccgcgcatccatccactccccccctctttcctgtcgcatcgcattgcatgctttgctccccacgcaatcaatcggagatcgatctcgtttccctctcttccttctcctatacaataccctgctcacttcttgaattgctccgcgccgaaacgcgcgcatgcaccccatgaacatgacgagctgcgaattcgccgccgtccgcctccctggccacccggcgctccggccgagccgcagtcgaccatctccgacgcccccgccgccacccgccgtagccaataagaaacca

SEQ ID NO: 379 - DNA, 687 bp, Zea mays
tcgatttagagatccccctgtctccttcatcttggtcagcacaaatgcaccgacctgactcggtgagtactgcttgccatctgttgtttcaacccaagcatcaccatttggagccttcacgattttgtatggcaccatcttcatctctttctgtgtctgtggatcatcaaagcgtcgcccaatcatcctctttgttccaaagaaagtattctggggattggttactgcctggcgcttggctggagtaccaacaagtctttcacccttctgagtaaatgcgacaacagatggtgttgttctcgcaccttcagcattctcaataacttttgggttctgcagtcatttaatatagttatttaactcagcaataaaacaaatatgagagacaaaaatcatgaagggcaaaaatccttatgagtaactcacctttccttccataacagcaacacaagagttagttgtccccaaatcaatcccaataacctcatttccagcagcttttgcactgaaagcagttaccatgcaaattagcattactaaaatcagaaaagcgttaagaactcaagcaggagataattattacctaaaaggtcttgcaaaatttccccattttgagcatatgttggcagcacatgttgactgtaagttggcacccaggggtaccgagatcgaattcgtacacaaagg

SEQ ID NO: 380 - DNA, 584 bp, Zea mays
tgttatgaatggcagattgatttctgtctgagaagtcgacgaaagttcaacctttgccttctcagcagcttcacgaagcctttgcagggccaatctatctttcgacagatctatgccctcagttttcttgaaatcactcaccaagaactccaatagtgtattatcaaaatcttcaccacccaagaaagtatcaccatttgttgctttgacctgagtagcaatacatagaatcaaatcagaacagtgtgtaattcagaagatgtttccacaatgaaaaaaagagtgattcagaaaacgtttccacgatgagttcacttgaaggttatggagagatacctcaaaaactccatttgagatctccagaatagagatatcaaaagttcctcctccaagatcaaataccgctatcaagccttccttgttgttcattccataagacagagcggctgctgtaggttcattgatgatcctttcaacatcaaggccagcaatgcggcctgcatcctttgtggcctgacgctgagcatcattgaaataagctggaacagtaatcactgcctttgagatagacttgccaaggtaag

SEQ ID NO: 381 - DNA, 675 bp, Zea mays
tattcgagctcggtacccctgctacactactattccctggcaaacgcattacagccgcagtactgctcctttggagcttccctgtcttgatcgggtggcgtcactcgttccatacttccatgggctgctagctgaacgctagccgacgatcacgactagacctggtggtgctcctgatctgtactgtacttcttttttgagcgaaccaacaaagcggcgagaagctctccaaaataaagccgctcgacgtacgcgacagcaacgtgtgccccctcgccgcacatctgcgtccaccaccgcatagcatcatcagtcggcatcatcattggatcgaactccaaagctagcactgcaggatgtacacatatatatataaacatcgtgagggagttggttgcatgcagtcgtcttgcttgcaggtagcgaggatcacacacacacacacacacttccttcagtgcgcgcactactacctgtcagtgagtcactcagtcagtcagtcagtcactcactcgcttcctcttcagttcgttcctctcgagaaccatatcccttttaattcgcatattctccctgcgtcgaacagcgcctttgcatgcgtctccgatcccttccacaccggctgcgccgccatctccggcgctagcgctactacggagagagatagcatcagct

SEQ ID NO: 382 - DNA, 598 bp, Zea mays
tgctatttatacgcctcgccccgctccagtctcagcagaaccaccagtcctccactccatcttctactccgaccacaaccacagcgaccacgaccgtgcacgtacgtacaggagcacaccaggcaacggcaatggaagcaccacgcccgcgtctctccatcgtcgccgcgctgtcggcgtcgctgctgctcgtcctcgcccacgcccacggcgcttcctcctcccccgctggcggcccgacgcccgtcgccgtgcggccctgggtggcgcggctgcaggcactccacgacctgtccgtgtccggcgagcagcagcagggcggcgggttcggggagtgctggggcgccgtgatggggctgagctcgtgctacggcgagatcctgctcttcttcgtcaacggcgagtcgtacatcgggcccgactgctgcgtcgccatccgcggcgccacgcgctactgctggcccgccatgctcgcctccgtcggcttcaccgccgaggaggccgacgtgctgcgcggcttctgcgacggcgaggaggcggaggccacccgcgcgccgccgcctgctgtgcccgctcctcccgcccggggactgggcca

SEQ ID NO: 383 - DNA, 616 bp, Zea mays
tgcacgtggttcctgtgacgaccgcctcaagtcaagtgggatgggagctccaacgttttccatttgccacacaggtagtgaaggcgagtttggcgtgtgtgctatgccgatgccagtgcgtactgcgtagcctagtcccgtccatcacattgcagtttcaattgtcaatggaacacatatatctgcgtagtttccttcactgatctctatcggtgcatcatcaaaactcaaagtcagagtaatctccactacaaatctcgagaacaaatgacaatctgacaagaaatctaacgtacgaataactatttccttcttggcacggctgtaactattacgtactattctttttttattatttgaaatggtgtacaagtgacatggtacaacacaagagaaccccaaaaaaaaaactttcggtgttttcttgtgacatcctcggtacagtcacccaggtgacagatttgcagtcaagaagaagaggcgatgagctacggacattttcagtggtaatcatattagaccagaagatccgcaaaaaaaaagttgccattgctggacagtaatagtacacattttttttccttcctttgctaagtcatacgattcaaaccgcaga

SEQ ID NO: 384 - DNA, 601 bp, Zea mays
tgctttcatcattttactagctttctgcacattccagttccttgctcgaagaaatcgcactaacgaggcatctgaaaggaagtctttaatggcttctgatgagtgttcgccaagctccttgcgtaattcatttatctgctcacagagacacagtgcagcaagttagaacttactagaaagtgcttaactcaatcccagcagagatgtctaggtaaggttgctcttactttttctcgctgttcttctggggatgggattttttcagtggtgccgccattgctagacttgaatagaaaggacattagagtagcttgaaggaggcaactccactagataactgcaacccgtgcataaatgcaattagaagaatgaacatacataaaccaatttcaatcgtctactctgcaaaaagtcaaaaagaaaagctaacaaaataacataaccaaaacttaacagaattattaaagtggtggtattcaggtaaataacataacgcaaagatctatatagccttgctctcatggcctcagtgcagacaaaacaaaaataatctagggataacaaatacatagagcagcatccagggggatcctctagagtc

SEQ ID NO: 385 - DNA, 663 bp, Zea mays
actctagaagaacccccctggtacccgcacttctacgacaaggcgtgcccggcggcgctccccaccatcaagaggctcgtggaggaggctgtggccgcggagccccgcatgggcgcgtcgctgctgcggctgcacttccacgactgcttcgtcaacgtacgtacgtacgcagatgcatgcgtgcataattcgacttcggttctctctccgatgtcgtcttcgtctgtgtgttcggcctcaccatctcttctgcgtttccattggtgcttgttggttcaggggtgcgacgggtccatcctgctggacgacacgcccttcttcaccggcgagaagatggccgcgccgaacgccaactccgtccgcggcttcgacgtgatcgaccgcattaagggcgccgtcaacgccgcctgcaggggcaacgtggtctcctgcgccgacgtcgtcgccatcgcggcacgcgactccgtcgtcgcggttcgttcgattcatccattcgcctccatctatcgtcttgtcgcacgcacgaaaacctttacccgtcgtccatgcacgcaacgcaacgcaaacacggcagagagctagtgcagctaatagcctaataataactaactaactgaactaattagttgcgcatgcatgcatacgtacgtgcaggggtaccaa

SEQ ID NO: 386 - DNA, 635 bp, Zea mays
tgcagcagtataattttagggttttagctctagtagtactcatccattcataattctggtttatatatgttcaatattccacatgtttatgagaggacaactaaacgtattttgttgaaatgaagtcatcggtcaacaacataggtacatgttctttctatcagatggcattatgaaagcatatttcatagttgtaagaatgtgaagtccctgttgtattgcataggatggttacatatatatatatagactcggaaccctaaccctaataggtcagcagcccaacagtggtgccagtctaactacatatataggaacacacacacactccaacaatagttgcgtccatggtaagcagtttcatgtttttatcagggttcaggatgcttcacatagtggttctaaatcctgaatttgttattaactgatttttagttacttctccttttgagcagctctgaggcatcctagtttgtatccgttttcagttaaccgctttgtacgaaaacaagcattaatcctatcttgatttcctttttaacttgtaatttatgttttttggtcaattgtcatgaataggcatttggctgggcgtatgttaacaattggcacaacacatgggagcaggggtacaa

SEQ ID NO: 387 - DNA, 583 bp, Zea mays
tgccgatgatgccgatgacgcccacggcgagacgctggagccggtccgacgccaacaccgtgctccgcgtgctgtgctaccgagacgatgagcctgccaacagattcttgaagaaaacctttaatctgcccaagaggaggtagccgattacgcagttctatcgccggcccataggatcggattggatctatcattcgcgacccaaagggcctgttcgtttctgttgggtttcacaaaaattatttcggctaatcaaaccttatataaattagacaagcaatctacgtaggaattgttccgagtgttcaattctctggaaccgaacaaggcctaatactttttttgaaagcacgttcttattatacacatgtaacaggaaacaggaaagcacgtagacggtggtgtaggtttggtgaggtgagaaacgggaggtcttgcattcctattgatttttcatcgatctgtgttgtttttatttacaccattggccgatattatttaatgatgtcatgagccatgtggtatacatgagcatgcatctccaccgcacctaacatgttcatgttagggctagttcgtttca

SEQ ID NO: 388 - DNA, 654 bp, Zea mays
ttgctgaccaccacctagagcctaaatgttcccttggtaggcggatttttagaatactggtttgatggggcagaaaaacatcaaagttgccattatttaccagctataagtagaaattcctgccttatctctgcttccctgcagctatcctatttattcttgtggcggttcctctgtaccaatttgatatttgaatctgtttgattgttccccatccgcaatttcttctatattaagggccagtgtgattgcaggttaagttgttcctgtatcctgtctcttccctgctgcatattgtatattgttatgacaggggattgggacttgaggtggtttggagcctgaaaatgtttctggttccccaaactcatggtctgaaattccatattgttgtttaacgtcactatttgtattgagttttactgtagtctacattttgcattgtaaagtagtactagatctaaagttttatgccctgctcataattctatggtaagctaaatccacataactaggtgatcaagatttcgtaggagtagcaaagcatgcccacagtatgttgtttgttgtgaccttgtcgacctatcatgatttcatctatgacatgaaacaatgtatgccacagtttctgatctgtctccactagtttgctca

SEQ ID NO: 389 - DNA, 635 bp, Zea mays
ctctaaagacccccctgatggatcgatcgagcgtagcgatctctcatcgtcggctacacgcagtagtataagttgcactcttccctcgtttcgaagcataggcagagagcatttaattttaacagcctatgtaggcacagttcgcgagtcgtgacaaaacgccaagttcacggcggaaccgctgccgccattgactgacgccgtggcattgccattgctgctgctcgcctcgtcggtgtcgagtggctcaaggtgcctgctacaatattacccgttgaaaaaattatagtacatttaattttaatttaatctaaaattaaagcactattacgatgacaaacagagcctatgtataagatctaaatatatgcatcatgtgacataaaattaaatcttgcttagcttagcaaaaacatgtctaaatagattatcagccgcagtaggaaagacatggttaaaggaagatggttctacatttctttcgtgatgacgattatataagacaagacaacgtcaaagttcagcacaattttattcttgctgacgacataaaaaacgagtgtgacgaggagaaaggcgagtcgtggtgatgaagttgacaaagacgacaagtcaagtaagcaatcgagccttca

SEQ ID NO: 390 - DNA, 591 bp, Zea mays
tggaacacccatcagccacacacaaccggatctcaagattgcttctgtcatgtggtggacgagagcaatagtccaaatacaaatagtctctgtatttaataagaatgctgctccaaggacaaaacccatcaggagatccacaatgatacttgaccacaaagcatgcttccgaattgcagctttgtgtgcatattcaacattcacagtggagctgagccgataataattaagtgaagcttagtattttcaataatctgcacttgagcatatgataactactatgtactaaatgtaaatgcacttaaatattcataatacaaagattacatgaaacaacaaaatggaagtgaaccagtaaactctcttttgtatattaaaataaccatgtaagattagtaataacagaatcactatgttattgcctttgtatatgttaatttataaggatagcacaaaatgttatgacaatatgacacaatagatattaaacaacgactaaagttacagtgcagattaagaagttacggatccactgttaatttaccttaaggaagcatcttggaagacaattggccagtagagaatttgaca

SEQ ID NO: 391 - DNA, 564 bp, Zea mays
tgtcgttcttttttttattccatctgattttgtgttatgtcacagtttatgatggtaagggaacccttgaggaaggggaaaccgctgaagcgcgtttcattaagatccaagcagcgtatgagctgttgattgatggtgaaaggagaagagcatatgatagagagcatcatgtgaatccgatgaaggtctgaattttcttggccacttaggttatcatttcattatgtgcaggatgcagttcctccactccatctttgtatttgtttgttaattactgttgtctgttgccacctattttactcgaggattacacattttagtcacagtattagttttttaatcctgatttagcttcatggttctcaagccaagaaaaggaagcatcattccatccttgtcagctactaacttacaaagcagtaatgtgtcttactttgtttttcttgcttcaaaactggactaggactgatggaatatatcagcaactaacaactgctaattacacgtgggtccaacattcatatgccttgaaatagttgagcacttgagaccttattatctgca

SEQ ID NO: 392 - DNA, 655 bp, Zea mays
tggaatccctgggtttccctaccattgctcaggctttggggaatctcaaagattccaaaaggtcttgcaaggtcaagaagtgtttcatcctttccgaggaggatgtttggctgatggccatataagaactgctggcatgtatcaacctgacggtaggcatgtatctggtgcagcttataaatggtctgcaccacaagggtatgatttcccacagccagcaaaaccggtttttctgttgcaagaatcatccccatcatctgtgatgatgtttccacaaactagatctaagataactcacttggaatatgagtactcaagacatgaggatggtagacttgataggactgttcctactcaagacatgggaagaagcaatcaaacattatctctttggcctcatcttgtttcaggcgaagcaatagaagaatgtactggaactgtgaatatgcactcccccgtcagtggtgcagagcatgaatcaaacaatgagagtacagttgaaaatggctgcaaaatctttggtatctcattggctgaaaagatccgatcatgcgatgaagcagactcttgtagtgcaaaatgtaattctcggctccagcctttgaagtcacaaatgccaaaatcgctaggcaggggtaccgaggtcgaattcgta

SEQ ID NO: 393 - DNA, 589 bp, Zea mays
tgctcaaacccatagtcaaaatagaattttgtaatagctcaccttattagtttctgatgtcccactcccatctgttactatctgtaatgtgtttatgtttgttggcacctatcatttctgcactttctgttggaatgattattattagtttgtgcttttgctttcatatggacaataacgaattgccatttatttgagcaccccaatggcaacttgtccttgttcatttcaagtttcaaatctttttttgtgcactatatcttgataagtaatcaatgatctgtcactgaaggccacatgatcttataatgacatggatatgattagtcttattaggtgccactctgtttgcaatgttattcagaacgtagatgcactgcttgctgtcctaatttactgattgacatactttatctggttttagattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttgggtaatgatcggcattcttttgctaaca

SEQ ID NO: 394 - DNA, 637 bp, Zea mays
attcgagctcggtacccctggtagaacgctatcggcatcgcctgctgctgatgcagttcgaacgtctggtcatgcgcgctgagttggatctgcatctgctgggctagactgttggacgagcaagagtcgccgagccctgcagtcgcgagtttcaggcgctggacctcggctgtcagtgcctcattcaatgctgttcgacaagacaacagaaacacgggattaacatagagggtgagggttcaactaacacgggattaacatttatatatgttctctcgaagcacatgtgggtactcctacatgctagtaattctttagaaagagtgatgagattaaataaaacacgagcaaatcttggttcccagatgatgcttagcacatcttcctaggcacttgtagctgtacctgtacgacatgctaacgactactccatagaaaaagcagccaaccaccaaagcaaccaagaaccaacccggccgcccggctgtctccaaatgccaacacgattcagagtttcagagccgtgggcacacgaactgggccggacaagccagcatgcatgtcaacgtcaacgaactgggaattaagcagcaagtagtgtgcagtacaggtgagatcggagacgcaccgtcacgca

SEQ ID NO: 395 - DNA, 609 bp, Zea mays
actctagaggatccccctgggaagcaatttcgaccagggaagctcattaacaggaaatgatgccacagccagtgaaattgaatgtcacagactccaaatggctgcaataaatgattatggatttggtaaacctgagattccttctagttcctcaatgccatttttcttggctgttgatcctcaacaactgaaattgagaaatgagacaaatgtttcttcaacatcttccaacattccttcagattctgcatcaccaaacttgaaaaatggcacggatcctcttttgatgccatttaattcctacatggcagattggagcagcgataagataacttacaccactctgaacactccaaaaataagcacagaacttccaggtcagtatgcatccctttcttctattattagctaaatcaatttagctgacaacaaaaacttaaccatgcagtcaagttacaccatgacaaaagtagtagctttgaagcaccaaacctgaaggagcatgaatcagtctttgcaacacatgaaatgacggtagaagcaacaagaaaagaagacgaacacacatcaaaatctagttttacttcctacaatggagtaccagataca

SEQ ID NO: 396 - DNA, 643 bp, Zea mays
tgtgcttgttgaaagtggcaagttcctcctatgtgcgaaacggacctcccgcccaacctgtacagaatatacaatatttatgaattctgaaaatttatctaggtcaagcaaaatgtacattggaaagctgaggtactaactcatgcattggccattcttttaggaattacataattctctagtatttgtgtatcactaacaaaggcctggtgcagtggtgagaactatctcactgagtcaccaggtcgtgagttcgaagcaacctcttcgcatttgcggggagaaggcttgccttggtttattccttccccagactccactcatgtgggagcttccggcactgggtctgtccctttttatgtatcactaatatatctatggcattgaacatctataggtcgaatctcctcggcacaaagtttgcaatatatgatacccagcccccatgcaatgcagcagaacccgggaaaacaagccgtcggttctactcccggaaggtgtcgccaaaggtctcctccagcacctacaacatagcgcaggtttcatatgagctgaatgtgttgggtactcggggccctaggcggatgaactgtgttatgcactccatccctacctcgtgccttgaggctggtggcactgttcc

SEQ ID NO: 397 - DNA, 705 bp, Zea mays
tgcatttcatgtcattttccattattatatcagtgaccgttagccttccattataattacctactctttccaattgcaaatggaactcgttttaggatttgttggtcaagctttaaaattttaaccatcactatataaatatcatcactatataaacgctttgtagattgagagcatttgaaataactaatttcaacattgaaacgatgttcacaacatataattattattttggaataacataacttcatatagatcattatccattagtcaaagtgccatattggaaaccaagtcaatgtccctgaatgacttgcatctacaataataagggactatgggtaacttaagtagaccacaatatatatggaaagtttggttggagtatgaatttcttcattatgttattttcgaataattccttttttgtgttggtggtttttaagttttataagctaatgcatgaatctaaacattaggtttgtcaagacttgagaatgggactattgagttattagatttctatagaagcttgattatgatgatgcatatcttgcaaacatggcatgttatgttacgagttatttgggcattaggcggttatatattagcctaaaatctcatttgcagtttgttaatatgtcaggagatgaagagtcaaggagtaaccgcagataagcttcaggggtaccgaggctcgaatcc

SEQ ID NO: 398 - DNA, 762 bp, Zea mays
tgccagtttctatgattatcactcattaattaatcagagatgctgtttgccacaaaatgaagcaatatggtagccctattttcacttcatatcagaaattcaactcctagtttatatttacagactacagaagcattagatcaatcgaacaactataggactgatagtatcttaaaaatcaaatgcatgatctacaacacagcagtagatgttgattaaaataatgcataacaattcggtacaatactaaataccaacattaacaacactagaacaaaaacatacttaggacatggaagattccatcaacagcacgtatatgtgagaggaatgcattgcccagaccatccccagcatgagcacctctaataagcccagctatgtcagttacttcaagatatgcaggcacctgcagagaatttcaacaaccacaatgcacatgaaacacgatttgaacagtcattgtacatctgatgatctgaaacataacctcagaaagagaaatgtgatttttactttctgggtgggagcagcagaacattttttttcaaaacttagtcaaattcaaataatttcaatagaaactgtaggggcttaaaggggtcctgcccccccccccctcctctctgtcactgaatatgggtaaagaaaagaaacaaacctcactctttggcttgtaaagtttgcaaagccaatcaaaccgttcatctggaacattcacccgtgcttcatttggttcgatggtacagaaaggaaaatttc

SEQ ID NO: 399 - DNA, 711 bp, Zea mays
tgctactgttctgtccttgacttggaaccccacgggcaggtaaaacaaccaggcaataaaattacaatgacgaaggtgacaagagtaaaattaccatccatcatccaaatcgatacgccatcctttcaaggagatccttgctatccgagggagaaaccataacgttaatggtccccttccctctccagcaaacaacggcaattgtggagggatccttacaaatggaatctacacgcctattccctgaaataccagagaaagttagattatgaactaactcatggtttcttttatctttactcttcaggtagggcataaacattaccttcgagtaacactacaacacagcaaccgggcgtcaaggacgcagcttgctccccgaatctggtgtcggtaaaatgagcaaagcttatgcttcggtactgtacgaggcggtggaactcaagtgcggatgcatatagtatcctctcgctgatggatggaagcaccagcgataatccatcataagacaacctatatgcacatggacagggatcctttgatctatgcctttcctgaaacagaacagagtacctcagagtctgagtaaaatatgcaatgctgaatcttcctacgagatcttgaatcggtaagggacaccgcgtgtttagagcgcttacaaacattttaacaccaagtgaagctatcttcagggggatcctctaaagtcga

SEQ ID NO: 400 - DNA, 715 bp, Zea mays
tgctttcttgagtattttatacttgagtcaatttagttcacagcttggaggcttgagttgttgagctttagcctgactggttggcccatcaaccaaactaccaaaaaagagtgaaaattgaatagacttggccaaccctatatgcccaaagaaagtaagatacaacggccaaaatacaactacacatagaaatagtgattggcttattgtcagtaaaaaaacatttgttgggtggggtacattctccagtttcaaagtaatagctcttccagcaaaaatacattttggtttagatttagaaacaaaattaaatagtctatcaataacttctaaaaatattcagcttcagagaatgaaaattatgtgtagatccattcatggtcttagtgatgatgtgatataactttgcacagtaaataataccaatttaacagtaaaactctgaaagtttttttaaacaaattagtaatcttcatcttgttaggcctggtgcagtggtgagagctgtctcattgagtctctagatcatgggttttttcttgaacacgcaagagagttacgtatcatttcattatgaaaggaaaaaaatacacagggaaaggaatccctaaacaccaagacaaactaacaatgtgacgaaccgaccagccgtcctgagaacaggtgacaacgcaacaacactagcactagcctctgttcgagacccttacaaaca

SEQ ID NO: 401 - DNA, 667 bp, Zea mays
tgatagttctgcaagcctgtgtctgagggtactagtatctttcttcggttgttcaccttcattcttaccaacatatacaaggacacagataaagcgaaaaatgccaggagcgaaggtaataaaacttttatcaacaagttctttgatcgtgaatgattactgatattgtagcactgtgctatacctaggcgaggaaggccacacagcgcattgttccccatcaatgatttgagtgtgatatttgagaacactcctccttctggtatctgtccatccaatctgttaaaagaaaggttcaagttggcaaggtaagtgagattggtcaaggattttgggatggcaccggagagtgcattggaggataggtccaattcctggatattaagtatattgctgaatgaacctggtattgatccttggaataaatttctggacagattgagatatatcatcatgtggagttcaccaaaggagactgggatgtcacctgacagcttgtttcctgataaatccatcatggtaattgctgtcaattttccaacatcagcaggcaggaacccacttaaagagttctgtgacaagtcaagctcaataagtttctgaagatcccacagacttgttggtatggttgaagacaatgagttttgggataacgtcataatttgca

SEQ ID NO: 402 - DNA, 771 bp, Zea mays
atacgatatcggctcggtacccctgctgaccgagtggggggcgctttctctcgagtccctcaagaaagagctcgcagaggccaacgcgcaccgggacgccgctctgcgcgaagctgccgaggtgaggtcgtcgctgggggagctggccaccaagctggtgagcgtggaagcgtactgctcggagctcaagaaggcactgcggcaggccaccaactcgccgtccgtctcgcggagatcgacgagatcagtcgaagcaagacgagagctcccgacgacggtgagccacgaggtaatggtggaaggcttcttgcagatcgcgtcggaggcacggctctcggtgaagcagctctgcaaggcgctgatccagcaggggaacgaagaatcctgtgacggcctgtccgacaggctgaacctgctcctgcgcccgtaccagctcgcgctcagcggcagcactggcaagcactgctcgaaggccacgctgtaccatctcgaggcgatcatgaaccaggccatgttccaggacttcgagaaccccgcgttccagcggaacggctcgccaaggtgcctcgacccagcggaggaccgccagcagagcttcgccgccttcgtggcgctgcgcaaccttagctggaacgaggttctgcggaagggtaccaagtactacagcgaggacttcagccgtttctgcgaccggaagatgagcggcgtcgtggcgacgcttggctggtcccggccgtggcccgagcaggggtaccgaggctcgaattcgta

SEQ ID NO: 403 - DNA, 708 bp, Zea mays
taattcgagctcggtacccctggtgctctcttctgcctgtaaattagctcgccggggttgcgatgccttaacgcgtgtcctgctgtcttactgtagctgtagccagtaggtagtatagtttcgttacactgatgcagtgtaggctgtggtgaatgacgtctgaaactacgcgtgttctgttaaaaaaaattactgcaggtctgtgcataaattgggttggattggcaaatcgggtgactgactgtttgcagcttactgagaggtttcttactcctatatggaaagagtttgccaatttccccaagacgaagacaagtgggatacgcgccggcgcgcgtatgcgatctacctcgtctgggctgtgttgactgtgggaaacgcgtgcaaaagtggcagcggcagcacgcgctgtggggctcatgggctgcggccgagggcgcccatcgggcccatacatgtgtaggctcgccgaacggaagaacaagcataggcccaccctcggatatgcgcccagttttacactaaaattatttccgtttttatattttttttcggaatcaaaaatgaaaatgataacttcgaagaccataacgacatcaagcgaaagctcagtaaaaaataccccaattacggtcgaaatctgacatacggtcggtaaaaatcgtggcggggcttggctggcttattgtagctaaaaacacggtacca

SEQ ID NO: 404 - DNA, 793 bp, Zea mays
  misc_feature (756)..(756): n is a, c, g, or t
  misc_feature (759)..(759): n is a, c, g, or t
  misc_feature (778)..(779): n is a, c, g, or t
aaagtaagcaaaactaagctgaaatctgcaagaagcagtattgagattaccaaaccaacaagatcctgcagttaagttcaacagaaccaagatcagcattcagcacaaaatgaactgattcataatcactctgtggacagtaacagtggcagagaaagacctgatgcccaactggtttcgaattgtgcaagatatgagaaaatgggtaaaacaaatctctcctgtcttttagtgtccttaagctattactattgagaactccaccagtgatccttttgcgcattagagcatccttaatcctggactgacttagttgagtatcagcgagcatgttctgtgtgctgcatagtataataataagccatcataaataataatgatgataaacgaaatcaataacataaaacacataataactcacgtgttctgtgtgctgcgtagtataataataagccatcataaataataatgatgataaacgaaatcaataacataaaacacataataactcacggtgtgtgttgctctatttttactctagggcttccatcaggttcggtaagtgcagcttctccttcaacagcataaacaagaagaccaagttggcagtaccctaatgctgtagcttggaaccaggcaagatcaacacggataccattctcagctaaagagggatttgcatgagattcaagccagttgatgaccggaagaaacgttactttcagatttccaccacggaccaaacgcagggggatnctntagagtcgaacctgcaggnncagcaagtcatagg

SEQ ID NO: 405 - DNA, 753 bp, Zea mays
tgtgacctgcaccattgcagtcctctttgtttgttcaaattagattttaaactccacacctcatggaatttgagtatttcagggctttcatgattgaaaatgtaccccaaattagcttataccccgaatcgtatggccctcttctgactggtgaagaagaagtaattggaggtgctggaactcgcaacgcgtttccttgccccatttctcttatttgtcggtaactactaatttctattgtgctgacaaggaggcatatcaagcattgacaataattcctctgttgcgaaatttttttggatggaggctatgcttgaaaacatgttggcatgttgcctttatacagtgacaacattgacttcgctgttaagttttcttagctttcaaaatgcatagaaagaatctctcattttcttttgatcagaagaatctctcattttccatatctctatctcaggtgcatcacatcatcttagccttggatgtcatagatgattagtgtgaatggttgcccatctgctagtttctgggttccctaagacaacatatgctcaacatctcgcaggaagaaagagagatggcacacctctatgagcgcaggaagttcccgtaccctggcgatgatgaggcggtcgaggagtttgtaaagagcggaggtgctcttggaaccacaattggacccaggggattcgctgacgccaatatggattctgaaaacatgcagaagcaggggtaccgagtccgaattcgtat

SEQ ID NO: 406 - DNA, 733 bp, Zea mays
tggcggctactagggcatgtcatgaccagacgtggtcagctcagtgagttgtgatcctgcaataactcaattggtgctctctagagttattggagaatatcaacttagattggattctctctttgttgttctactgtctttgcttagttaagcacttcagccatatgccattcgtaatgaaatagctttggatgttgcagaaaattttgattgacatagagagtcctattttgacctttgtaccactgctttaatttgaatgtggtacaaggagaaacataccaaagttcgaggtaagacactggatcatttgaactttctagcgttgtttagtttcatatttctgccatcatgcatacttaaattgtgaaatgtgtatatgtagttcttaacatatgttaagtagcatgtggttttagttttttaccctcttctaaattgggatatagtctttccgtacctttatgattgaggttatagcagttttttgtgctcaaattaacaaaaaagtatagaataaccacatgcttctattaaacctgcctttttctactttgcaacttaaattaattctcctaaaatgcatacatttgcattgttcaaaactataaatttgtcgattgttccactatttaagatacatttttagatactgtgattgatctcattaaaccatgttggtttctacaaccaacttaacagtcaaggaaaatttacattggtaccggacgca

SEQ ID NO: 407 - DNA, 720 bp, Zea mays
tgaggggagaggattggagggaggtgctatgcggcttgacagtggaaatgctagcgaagggccaggtcccgtgcttttggtttctgatgtcgtctccaagaagccaatgagtcaggttgaatcgagagatgaattggtgaacacaagtgaggctaggaatttggcatcacaagcagagagtatggacctcgacggcagggagtcatctatggaagcagagatcagcgcagagaacatggctaggttggctgggatgtctgcaggggagattgcagaggcccaagcagatattgtaaataagctgaaccctgcattgctggagatgctgaggcggcggggaagggagaagtctggaggcacgaaggatgtgggtaaggacaagggtctgaaaaactcagggctgcagaagaataaaagggctacaccaggggattggttgactgctggtgaacatactgggcactcctggaaggtgtggagcgaaagagtggagctgatcaggtcttgtaggttcacattagatggagacatattggggttccaatcttctcacgagcaacaagatggtataccacatggttttgctcatatgagctacatttgcttctgttggtgtggtatcctttagatgacaacctatatctcccactttcaggcaagaagatgccttcagaaagtgttgctgagcgtgatttccttagaacagaaggtgatcctgca

SEQ ID NO: 408 - DNA, 747 bp, Zea mays
  misc_feature (709)..(709): n is a, c, g, or t
tgtatccgaagttttcatgtcgtcatcagtatgtcactgtagataccacagcaactttggactgaatatgcatggacttccaaagatgaaaattttgcatgtgcagtacatttttacttacgttcttaatttcttgcaagatagaatgattattcttattttaatctctgcatggagcagtgaggttcctaatattgttggttcttgctgtgtagaggctatgtgataatgatccaggggtaatgggtgcaactctatgccccctctatgacctgatttcggaggaaccaaattcgtacaaggatttggttgttagtttcgttaacatcctcaaacaagttgctgagaggaggcttccgacttcctacgattatcaccaaatgcctgcaccatttattcaggtacttgagttaaattaaacattatttatttgttaggtgctgctaggttgctattgcgagttatgcttcttttatgggtttaagctttcagttgtcaccatgctatccggctatctgccttagattttgtttctgtcatcggcagataaaactattgaagatacttgctgtgcttggcagtggtgataaacaagcaagtggacatatgtacactgtattgggcgacatattcaagaagggtgacactgcgagcaacattggcaatgctatactgtatgaatgcatatgctgcatttcatccattttcnccaaaccctaagatgctagtggctgcaggggtaccgag

SEQ ID NO: 409 - DNA, 680 bp, Zea mays
catactcctctcagttctctgtattccctcctcaaaataaaccatcctaatccaacaaacactacctctgccagaaatattgctgacaagaatccatagaagtacagatactttgatccactatgatctctcttaagcttatccagaaaatctgctatgaagtatctatttgttgtaccacagtcaggactatacttgggaccaaaaggttgtgattgcggaattgaggcatccaacacttgtaatccattaggaatcttgatgtacatggtaccagtactaacaaagttctgcagggttacaccgccaacaagaacagacttcggatagcaatcaccaatcccttcccagtatgcaaaacccttgcagttgcaatcatgcaggcactccttcttgcaaaagtcaagagaaacggagtgatgggcagtcatatcataccccaagaaatcagtgtggggtagcttagcaaaatccaccttctccacatcacaactgatgttggtctttggtctgcagcctttgctccgctcacttgggtcgatgacttcaaaaccaggggcacacgcacaagcaggcacaggcgtatacacacaaattccgttttcgccacacagaccgtgtacattgcaaagctgaggaaacgccatccatgtgaccgaccatgttctgtctgccacatt

SEQ ID NO: 410 - DNA, 763 bp, Zea mays
tgtaagttatctacttatttgttccctattttcatttatttatttaaagttgagatttatccaaagtattgttagtgtaatgttttttcttctgccacattaggtttttgtcaatgcacggcttcatgtctcaggaggggctcttgggggtggtcgcatggtagaagactcctcaagcgttgcaggttccatattttaaactttctttgatgatcacatttttgtagtattctttttttacgtaaaacaattctgtggtattcaatagcaaattatacacttcttacaagtcaacatatagatttcactatctcagtttctttggaggttactagcagaaaagtaatttagaaatgattaatatattttactgaggttctcaacgttgtgtttttcggttgctggtaaattgctcatttgctgctatagttgattagtaaatatagcagtatttatgtcattactggttacttgtaatgcaaacctttttcattgaagtacatgttctgtaaaatactagaacatggtcagtactttcagcattggtcactaacttttatgttttatgcgagtaataatatttctatttccatgtttatctacttagtttccatgccatgccgccttttcagtattggacactgctgctggagtttggtgtgataccaaatcagtagttacaactccaaggacaggaaggtatagtgcagatgcagcaggtggtgatgcttctgtagagcttacacggcggtgcaggcacgca

SEQ ID NO: 411 - DNA, 704 bp, Zea mays
tgcctccagtatcaggtcatgcagggtcccggtcaccacctgccgcttggatttgagcaccctagtaaactccaaagcggcgccctgtacaagaaaattctccaaatattatgaactcggaagaaactcagcgtggctgtgggggtacatacatctacggagagatgtgagatcatgccactaatatgagaaaatacaagttcaaccattaaccgaaacgttgattctagcaaatctagtaggtcactcccccaaagagttgagacctaagtttaaggacccctgcaagttgatgcaactggaaagcccgttagcgaatccatggacccaactcttttcccctctcgggagtgaaacttcattgacctaattaggtggcgtcacctcgtaagtcaatgcaattcactctctctcatggtagtacataccaagagtccacacgctgacggaattggtatcggcaggctggagagacgaggagggaggcgcacacctggttcttgttgtagtgggcgacggcgaagcgagcggcgtccacggcctcggcccgctcgcggagcgcggcgagcacacccctcacgagaccgctctcgtccccgccgaggtgaaacccggagaccgcggcggcggaggccgcgaggagcaccgcggcgaagagaagggcgcggcgaggcatcatcgtcagcgcggcgaacctactacca

SEQ ID NO: 412 - DNA, 1092 bp, Zea mays
cagaaatattatcttcacattcgctcataaaatataggtcagcaaacacgcacaccaaatcaaataaaccagatctatacatcactcaacttatattctctgacagtctgaaaatataataatttgtttacaatcataatatatattataatattataaaatcatatatataatttataaatatttataaaaaattttatataaacgataaaacacaacaaaaatatacatttctaataacaataacattattcaggttaaagatatgctgttctgctcacatcgcagcatagttgacacatcctgtgctgtaacctgcataaggtttgccacgggatcacatcagaattgagccatcatccaacaaactgcagcagggcgtaaaagatagtttgatcaggcaatgaaacctcctcacctggaagctcccatcaccaatgaaggcaatcacacgcttgtggttcgcaccctgagcatatccgagcaatgcacccactgaccatccaatcgaaccatactgcatttggaattcatacctgcagcatgcagacagttctcatgagaacccaggaacagaacagagttcaagagaaacaaacagaacagagcaccatcagaatgctcacccacagccttctggcagcttaagcttctggcagttgaaccaggagtcaccagtctcagcaatcaccgcactatcaccagtcaacatcttctggacgtgcttgaagagcacattcactcgcagtggctcatttggctcgctttccagcggctggccctcaggtacaaagatcctcttgtaattctcataggcagtggtgttcttattaaccctcttagccaattcagacaagaactctttcatcatacaccatcccgatgattgtgtagtatcattcatttttttgtgtttgttttttaaatcaaatttatttcttatataaactcattttctataaggtatggtttcggcgtgtcaaacttattgttttgtgttatgtttcggtgccggtcgtttggttgactgggtgttgaatgttgtcgaatgtactttttgagatataccaaatataacataactatacaaac

SEQ ID NO: 413 - DNA, 920 bp, Zea mays
  misc_feature (468)..(471): n is a, c, g, or t
  misc_feature (473)..(473): n is a, c, g, or t
  misc_feature (869)..(869): n is a, c, g, or t
  misc_feature (890)..(890): n is a, c, g, or t
tctaccagtacaaccctgacggcgccatctggggcaacaagatcgcgtggggccacgccgtgtcccgagacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccagggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcatannnnanattgcagtcccaacccgcgcccgcaaacccagccctaagaaaggctcccccacagatcccggcaaggggcttcgtttggcttcagccaacagacagcttgggaggaggggtaggagccgagccccaaggtacagccatgatgacaacctcaatagaaagtgttaatgttaaacaaaagacggcgaacaattgccaaccacgatgtgttctaaatctatgatgatttgaaagcggcggcgccgaccgggcccagtctgtaacagagaattctgtaatacttgtatagctgattgtgatcggaggggggtatcggtggccggggactgcgtcttatcacgaggtagccaggattctcgatgattagatggttggacggcgacaagggcaaggatgagnaggtgagggtgaaaaaatgantcaaggggtgggggagaggggaagaggaga

SEQ ID NO: 414 - DNA, 287 bp, Zea mays
cgaaagctcctgctcacttgataatgatgcttttgtagcttcgcatcaacctcgagctggtgattagattcttcttgattttggaaggtcattatatagctcacagcagcaacgctgtaggacgaaattgtacttgatctatttgaagagcaactatatgcgtgaattcagcaatgatacttggaatgttcaatcatctgttggctacatgaacatgctgcggtttattagtcttgcacacacttgtcacaacagcagaagaaatagcggtaatactcccttcccaa

SEQ ID NO: 415 - DNA, 452 bp, Zea mays
ctacctcgtcttcgactacatggtccacgacctcgccggcctagccgccagccccgacatcaagttcacgctgccccaggtcaatatcccattcagctgacagcctgacacagcatcgcccccaattacgagaaatgcgactgataactgattgaggtgtttctctatcgggccaggtcaagtgctatgtgcaccagctgttgtcaggacttgagcattgtcacaaccggggagtgctacatcgcgacatcaaggggtctaacctgcttttggacaacaacggtgtgctgaagattgctgatttcggtctggcgtccttcttcgaccccaaccataaacagccaatgacgagtcgggtggtgacactctggtaccgcccaccagagctgctgctgggtgcgacagattatggagttggcgtcgacttgtggagcgcaggatgtatactagct

SEQ ID NO: 416 - DNA, 854 bp, Zea mays
tctaaaactgttgccgagacagtggtcttgattggaacacctagtttgctgcacaaatatattacattacataatgaggcaaatatatattacattacataacaaggcaaataatatcgagtaaagcagaatagcagatatatcatctttaagctacctaaacagagcagcaaacactgtatttacagtattgagacttgataggtccagctccagttcctgactatctgcttcaatggcctggacagtaacaaaaacattagtcacacgaaaaaaaacagtcagctcaaatgctcaaccatgcccccaatcacctcaaaccctgatgcatcatactggcgcctcttgtctggatctgacaggatattataggagaatgtggcctcttgaaacttctctgaggcaacagggtcgtctgaattcttatctggatggtacctgcatgacaaattttactagatatataaatactcagacagctgcatcgtcaccatcaatttatcagtaaacaagatagctaaacagtctaaactaccaataacatacacataaggcaggacagagcttcttttttttctttgcaagacagagccttgcttgttgttccaatttataatgcacgattcagaagctatataatactggtctttacgtggttccaaaaggagaggaatttattcaagataataaaacaatatacagctacgcatactcggaacaaaataagcacaaaatgcgaactaatctacaaaaggaatttgaacacagtcattccctctgaggaaaataagagcacgcgaagtgcccaaatccaagaccattgcagacaatacttacttgagtgccatgcggcg

SEQ ID NO: 417 - DNA, 476 bp, Zea mays
cagcaaagttccatgttcattctttctgacgggttgtcctttgaacatgagacaccaactcgtatcacagaagctaagcaactgagcatctcaggatcatggtcatacagctccgcattgaaaagttctgggtcaatgatttctgatatcctgtcaggtaaccctgcctcagcaaacaagtgcagggtcaagccttctatgaacatgtcatcagttggtgctttccccgtgaacatctcaagcagagtgaccccaaagctgtaggcatcaccagcaactgatgcttgaccacctgctccatattctgcaggaatggaaatattatgacaagttgacaatgccgtaaaaagatgatacagtaagggcaccaaatcaaggcagtttattaattgactagaaaaaaaatgtggtttctgaatggtggacgtacctggagggacgtatccagtggttcctcgtatccgaatagtgctttc

SEQ ID NO: 418 - DNA, 621 bp, Zea mays
tataaggagcaagtgagagcttgaagtccacctcaacgtggattaggggtgatcggcaaatcaccgataccacgggataaaattcggtgtctttactttcttgcattacttattgtcgtgcaaattattagtgttttgcatattgttcttcaagtattcaatcaccttagttgatcatcatagattatttacttgttatcactatagaatttatatctcttgttatattgattaaatttccctagtgtttttgattttagtcaaaaccgtctattcaccccccctctagccggtgtcctagatcctacactcgtgccgtgtggaaatcagaaatcaccgtcgccgtggactcttgcccacgatgtcgttcgacgtgcatgtgggagcctgggaacttcatggatgcgagcggaattcttcgtcgaagctagttggttgccgctactcacacctcaccgtggatggggtcctcgcgccatgatttgctggtatgtagtcccctatcaaatcaccatgctcctagcatcgtatagcacctgtaggacgagagtttgcgtgcttgaatagagtaccttctttcacctgcgatggcaccacagcggggtataatgactgtttgag

SEQ ID NO: 419 - DNA, 554 bp, Zea mays
tttatgaagttgtgacgggggttgctaagaagcaatcgaaagcccccaacggcagcagcaaaagcagcaaacctaactctaaagtaagtaaatatcttttttttgtgcctgtgtggctcaaaagtaatgcatatgtgctacatctcatatgcattacatgttgctaatgctgttgatgcaagacccctggctcgtttgctctgccatctcttgcagccatcaaaactgaccaattctaacagtaagcccgcgaagccagcccacccaaaagaagaggaggacagcggccgggaggacgcagaggaggaccaggcgtacctgtgtgggtcctgtggggagagctatgcgaacggggagttctggatctgctgcgatgtgtgcgagaagtggttccatggcaagtgtgtccgcatcacccctgccaaggcggagcacatcaagcagtacaagtgtcccagctgcagcaccaagcggagccgagaatgacggcaccctgggaacaggacctgctcccagttaacggaagcattttagaatcattaggagctataacg

SEQ ID NO: 420 - DNA, 1244 bp, Zea mays
tttaggcttgaagagtttgggagctggccttatgaaaaggtggtttgattatgccattcgctcccttagaatttttttaatatggttagaagtacactttttattggcttgtaaattctctctaacaatgcctgtacaatatttctcttctactactattaatatctagaacaataggggctgcccaaactgtagtgctttaaaaagaaacaatttcagagttattttagaattttgaaaaccattttattattatgaaagcaagttattttagaacattcaaacgcaaccaatgatttttttctgacatgaaaagttcattcatgttttgatgagtttttttaatgcaaattaactttggatcaacatagcaacttagcaagcaatttattctacaacttttttgttctcttttatctgaactctgaagtcttgtgttgaagtctgtgatgtgggaatagaagagctcaccaagaacatgttggttaacctttattatgtagtttcctcagtttattatttcttgatcccagtccctcgaagagctcacaaagatggcccataatttctatgatgagactgcactcccaaagctggtaagccttgttttagctattttgttaattttctttaaaattttgagtcacttatagcaacattcgctactttagctatcttgtcctgatttgttctttaattaccctatataaaactcttgttatggtacatgatgttgagttagtttacttaatagtatcagagtagtcattctcaagcatatatgatcttgggatgttttattcccatagtacttaattcattttttttttcttggaatacatttcgtacaggtggctgatttcgcgtcccttgagctttctcctgtggatggaagaaccatgaccgatttcatgcatacaaggggacttaatatgtcctctttaggtcgtgtggtgggtgtaaattttatgcctaaatgcttttcctactatgtttggacaaagttgcataataatctgatattgtttctttatattaatcaggtagagctagcagagaagctcccacacatccagtctatatgcattcatgaaatggttattagatcctttaagcacatcgtccgagctgttattgctgctgttggtgacatgcaaaatatttctgcagctatagctgaaactctaaacatattacttggatctcccagacttaaaaggtgctacacagatgcccatattaaa

SEQ ID NO: 421 - DNA, 842 bp, Zea mays
atgagcaacgttctaattaatttcactagacgggcaatgttgacagcaagaaccacagatgagtcttatggagagctctaacaaaaaaattgcaagtcaagttggaagtttatctctgatgggatttgcatagtatgtctgctggttcgcattgttacattgtgtctgccaaaagattttatgcagataacaacccggagcttatgtctaacatgtgaatgcgtttgagacaatgtaccttgacagtgtttagtagaactttggcttcgttattgttgttgaagtggtcacgaacaggctggaaaaattaaattagtgagtcaaacctacaagtgtgaaccagcactgaaaattgtgtaataatagcttcttcctcgacaaaagaaggacaggcaataaacaagatggacaagttcgccagaaactacgctagcaagaaacaagagcgatgatgcagcaataacgacagcccatcaattcattttgtcaggacagcagctatttcattttcaaagaaatcacagtgcaagacatgagattggtaaagatcaagaatatacaagtttctgaccagagaaagactacaataatatcatagaaaaaaagtagggtcgagtgaagaaaattgcacctgcaaaatttcatttattgcttttgccagtgcaggtttgacatcagcaggatgcaaagcaccagtctcataatcagaaattagttcatccatgcttgtaaatgtcctgtttgagtgcaaatgctttagaagtataatccgagataataaatcatgtcacgttggaaattaaaataacctatttgctgcattaataaattgcatgaccaca

SEQ ID NO: 422 - DNA, 847 bp, Zea mays
agagcaacatttgagataaatgcatatttcatctgtggaggagaacaagtcaagtacacaaaatcttgctcaggtaacaattgtgctcagtaagacatataccttgcacttgtccaattgcgtcggaggcaagcatcggggtgcagtgaagaaaggtgtttttggatcgtaaaaatcaaacttggaaggctgaagagagaaacatattaggtaaatttgtgtttaaattctagccaacaactattaaatgataagctaattgaagaaaacaggatggaactaagatggtctaacacattctatgcattgaattccaggtaatatatatgcagtacagaatacatgacagagtacctgctcagtgagggccaagtttgcatcaaagaatgatttgattgttccaacatcctcccaatagcccgtaaaaatgcatgcctaacacaatacgtaaaatgtattgttagtatgtatgatgcatggaagcgaaaatacataaatcgtgcattggtaaataaaaactagtggaaactggaaacaaaaacaactttttgacatgaagaatttacagtttacagaacacatactccagacagatcagacttacctgcacactatgatctagtacagctcttgggaggatttcagatccaaagtcatgtaattgagtatattttgacctaagaattgacactgttagaaggtaaactaggagttggatagaaataagtcacaggaaagtgattacttgagaaggtctaaaagtgcatctttcttgaagacataaatgcccattgatgcaaggtatggatatttctgtgcatcatctatagcatagctcaagaagttg

SEQ ID NO: 423 - DNA, 1264 bp, Zea mays
gttgccccagtagttaacattgacaggtactactgctgctgcagagcacttcattttgcaacttgaaaaggttgagataaacttctgtattgtgcaaacaaatttataatgttgcaatttagtgtgtatatagatatgtttttattgtaattttgcacttgtcgaattttatgttatttgttcgactccaaatttatatatgaatagcctatctatcaagagcttaatgctctaatttttctctcccacttaggcatttgagtcccccaacactcatgctgagtgcttcacatatctgcggcaatacgcggagaattgttctgcgaaggctgcttgtatggtggcacctaagagcatcatctcctacccacaggtttcaactcacctactcctgctcttgttttgctgagctatacgtccacaatgcgtcgctgctagcttcacacttttttgttgcttttcatgacaagttggtgttgagcattgtcagtattggcacttcagagtttagattggagaggaaggctaacacgttgtatcacgaacacaggtctggaaagggcaagggtcgaggaagtggaagcttgaccagagcgacgggttcttcgtgcaattcgaggcaccggcgctgaggaagatatggtttgtgccaagcacaaaagagaagggacggacattgtgcaggtaaatctctctctccctcccccttttttttcctacttgacagttctaaagtagtcggttcagaactagtttcagcttccaaaaccagtgtcttctaaaattaaaatgctgtccatgcgctgccgtactgctcaccttgttcagacgatcatgcttactagagtaggaccaagaccaacaagtgaactgtgcctgtaatcgcaaatggaaaacagaaacggcaaaccttgtcatccaccttccaccatgaaaagcctcacgtccttccctctttatggtagtcacaagaggtaggacaacgtactgtactgtactgactggagtacatcgcgctccccctctttattgcccgtgcacgcaggagccctgaggccttggacatcggcatccatgaagtgctcccccgtatattcaaggaggcagcttaagcccaataatggaggactgtccatggattcctgatcctgcacagcgcttgctggatgttctccctgggacctgggaggaggaaagagctcgcccgacatacatttgttaaccagtgaatcggctacgctggcagacgcagactcggaagaaa

SEQ ID NO: 424 - DNA, 231 bp, Zea mays
gtcagcatgtgatccgtgctaaggccttacagttacagcacactgtatgccggatttgtgttgctttatttatgttcctgcccgtgtatctaatcgttttgaactcaaggggagaactagtgacctactgatgagattaagatgcagcactgtttttgctagcgggaggcctatctgcagaactaactagtcatgtctgaggccctcagcacatatactctgtttggcatg

SEQ ID NO: 425 - DNA, 495 bp, Zea mays
tgtaggctcctattactactgcaggtctgcaggcaagagctactagccgctgcatgcatgagcatgagcatgatagaccactagagccgtggacatagtgctacagtagacggactagctagctagctgcaaatgaacgcgatccgtctccaaaggccgggagcgcaaacatgattacggatcaaaagctaggccatcattgtacgctgttagtagcagcgctccagtgcgcagtgattgattgctttgcttcctcgccatcgcgcgcggcccatccctgcctttttgcagatccgaaccccggccggcgccggtcggccggccgatgatgcgcgcgcgccatctatcgcttggctgcagtgacagtgcagcagcaggtggtagccatcacgtactaccaccggccggagtcgtcgtcgatccggccggagcggagctttctcggtgacggtgacgctagctggcatcaatggctgagaaaaaaaaaaaaaaaaa

SEQ ID NO: 426 - DNA, 368 bp, Zea mays
gtcggaagacatggacttcatctctgacgctacccgaacacaccaatggatttaatttgaccagtccgccattaatttaggtgtgttcgtgacaaccgcggaacaacatctccgacgagcccgttccggtttacacgagtcggttgtattcaatccaaggactcagaacgaatcagtgacatactaggactatggtgcttgcgcaaatttggacaggggcaactcgaaacggccggtcaacatgagcaatgtccacagcagtgttcctaggtgacaacgcgtcttccttaagctatggcacagtagcgttcaattggccaagactaggagcttcactggtagtaaggaatgctaaaacatgagtccag

SEQ ID NO: 427 - DNA, 528 bp, Zea mays
aagtttcaccagacgctgcctgaatcatgttctagttttctgttcttgcatacaaaagattgtagtgttttcgtacatatttatccataataccaaatcagatacatatacatgcttaacgcttccttctaatatccaagtatttgctgccccctctttgattttgtatgatttattatggactattggtataatgcagctggagttccatcagagaatattctttatcttggcggacctaatattgcttctgaaatttacaacaaagaatatgcaaatgcacgtatttgtggagctgacaaatggagaaagccccttgcaaagtttttgaggcagcctcattttattgtgtgggataacagtgatctcatcactcatgaagtcatgggtggcttaaaaaatgtctatgctattggtgctggtaatttctatttgtctttttcactgtttcctgttttcttgattacaatggagagctacatatatcattatattaagaataaaaagatgggctagaaacccttgcac

SEQ ID NO: 428 - DNA, 564 bp, Zea mays
agacgtggtgacggccacgctgacgacggtggcgcgccgcatgaccttggactcggacggcggcggcgcgcggatggtgtcctggatctcgatgaggatgagggagtaggagtaggcgaaggcgatgtcgccgaacgcctgcaggctgcgccacactcttgtcgaccggggtgaccgcgccgacgctgatccccgtcaggctgccctgcacgcccttgttggacaccacctgcgcgatgcccaggcccaggccgatggtggagtaggtgaaggacatgacggcggcgaggatggagagccacgatatctggtcgaagtccgggatctgcgagaagaaaatctgcacgacgccgaagatgatcatgtagggcgtgctggagatgttgcaggggtccccgtgcccctccacgtggaagcagttcgccctctggatcgccctgcatgcagcacacgtacgtcgcgttaattaccaaattatatatgctgagctcagcctcggacgaagttctctcgtggtctttttctatataatatatactcacagcatgctaatagaggcggaat

SEQ ID NO: 429 - DNA, 709 bp, Zea mays
cagaaccatagcacacatgctcacaaggcatcgtgctagcatgaacttcacttgtgctgagatgagggacagtgaacagagttcagaggcgaaaagtgcacctgaggaactggttcaacaggtttaagccattgtcacttgtctgtattctccttttaaggaacacaaaagggacttttcaatcattaacaaaatattctggtgcaaactataaaaaatggcaggtgctgagtgccggatggagagagggcctaaatttggcatgtgaaaatgcactcaaccgatatgatgcaacagcttacaacaccatcctcaggaatgcaagacctcaaggcatcaacaagaatggccctccagaacacaagttgcacggattcacctacctccgagtatctgatgaactgttccaggaacagaactacaccactttcaaaacttttgtcaggagaatgcatgctaacctggtgagtaacacccttgaaaatctagacattcataattggacacatttatgtttgagctacacgctgacagaatatatataaaaaattcaggattataatccaaatgtcgacccagttgcaccattggaaagatcaaaggcagagataccaattgaagaaatcctagaagtagcacagccaaaattggagccatttcccttcgacaaggacaccgacctaccagtttaaacactccatgatgcaac

SEQ ID NO: 430 - DNA, 527 bp, Zea mays
gtcaagggtttctagcccatctttttattcttaatataatgatatatgtagctctccagtgtaatcaagaaaacaggaaacagtgaaaaagacaaatagaaattaccagcaccaatagcatagacattttttaagccacccatgacttcatgagtgatgagatcactgttatcccacacaataaaatgaggctgcctcaaaaactttgcaaggggctttctccatttgtcagctccacaaatacgtgcatttgcatattctttgttgtaaatttcagaagcaatattaggtccgccaagataaagaatattctctgatggaactccagctgcattataccaatagtccataataaatcatacaaaatcaaagaggggacaacaaatacttggatattaggaggaagcattgagcatatatatgtatctgatttgatattatggataaatatgtacgaaaacactacaatcttttgtatgcaagaacagcaaactagaatatgattcaggcagcgtctggtgaaactt

SEQ ID NO: 431 - DNA, 810 bp, Zea mays
cctggcagcggcctcccccgcgacccatacccgcgagccgagaagccgccaccgctcctcctccgtggcctcgcgcagctctactcccgcggcgccgccaaccagcagctgccagagaagctcgtcgctgacctccgccgccacttcgacgctctccccaacaggtcagtgtcccaaagtcgccacctttttgcatattttttcccccttatgccactacccaattctgcaacaaaagcgaggtatatattagtcaacagactttttttcctctttgggtgaaattttgcaatttctatagagagataaaacatgccagtgcctctatcgatgacacaaatctgctgcaacccgagattagtttcgtaagcaactaagagacggatctctgttctgccatctttgtttttaacttccagagatcacagatctttcgttaccgtgtttatgattaaatcaagcacataatttgatatctaataagctaaggtgacagtgcatctctctctggctctgctgaatggttgctgacaagcagaaatttcgattttgcagctacgcacaggcaggatatgacatgaaagatgtcctcctgcatgcccgccttgcagagcaggcgacaggtgaggatcagcctgcagtgaacattgaggaagttcatggcagaggaagttgtgaagaaggcactgttttccagctaacatttgcttgcacagccccgctctcatggcagtcaatgtcaggatcactagacagcccttcgttctgttgcaagaagatccagatctttagaagagagggcttacactt

SEQ ID NO: 432 - DNA, 1128 bp, Zea mays
ctttatgcaaaaggcagagcataaaaaaaatgaagtgtcgctgattttctgtcatctccagtatacagattgtgcattggctccaaattttacagcacatgaatgttgaaaatactcctgacctgtgaaaggagggagaggattgcaatccctgcatgcccaccattgactgaaacattaacctgtttggggccagagtccaagaacccatccctgctaaaacaaactggacgaattacgagcccatgaaggattacaatgttgcatagcatatcatgtcaaaaccctattgatatacataccacaaacgtattcagctctcactacctgaagtgtggacaacacctaaaagccgcttaagggcataagcaccagctttcttgaaaactccagcagcaattgggacggtagagttgacaggattactgatcacattcacaattgcattagggcagcattttgcaattccttcacacagggtacggactattccagcatttatgttgaacaaatcatcccttgtcatcccaggtttccgagggacaccagcaggaattattacaagatccattccagccagggcattttccaactgtggctggcccaagaagccacgtacctgtagaatttattagcataactacccccaaagataaagaaaaaaatagacataatggtgaacaagataaataattttatgtttgtaggacacagcacggggagggcgggggggtatccagatagcagcgagtggtcagacattaaaaaaattaatggatatctgaagatatccaggtaaaaaaattgtgactgcatttcacaaggcaactccaatttgtctcccaagcattccagtggaaaattgtagtacttcagaacgagtcttaagtacagtagacagtagctaatatgtgtttgcagatgcaggctgcagcactttatgtcctctaaatatgacctaagaatccagttgggaaccaactgcagtagaggtgtaccatcaactagctacaacagtaatgtaccgtctcggataaagttaagcataccacagcaccagtgttcatgtggctgatgtcggctgtgacaccaggtgcgttacgacatgtatagatgagcaccgaaaca

SEQ ID NO: 433 - DNA, 1128 bp, Zea mays
tgatgccaaagaagtgccgacattagagctggcagcacccagctgctaaatgcatcgcaagaaatgctgagttaaagctccaacatgtgcagtttggcttgcaaatatatagtgaataaagaagtacgaggcctgaaggacaacaaatgctgcaggccagctcaatgagaaagattgaagaaccttggcaacacaattcgacatccaggacacaatcccaaggttagtaagctgcccagccaaaccaactaaaatagcaaaccaagctagggtgtcccatgcagacttctcattcaaacaatcctcccagtttagcactccaagcacaagaagtattgagagtccaatcattgcagcaacaacgctggatacgccaatagtttccctgccatattagaaacaggctgagtcttttgtgttcctcatcaacaaaaaaaaggaaaactggatacttatgaatcatattgactcttggtcgtaaagaagaaagaaaattttagctgccaccacaatcatgagtggaaccacagactactacaggaacttttcatggaaaactcacagaacaatgctcctcagtgctctgtgatgtgaacattatcacaataacaactacagcaggcaccagtcaagaaaggtacttgtgctcttgagctatgtatatatacttaggtcctatttaggaatgcttcagcttcataaaatttagtaaagttgatgaagcaggacattgggagcttcaaacaatcatgaaactgaggttacaaacttttaaaagacatttggataagtcattttgtttcttatttagattaaaaatatttttaaaactaattaaatttatattatacaccacagcttcacgctgaagctggaacccagagctgtgccaaacacgcccttgcatgattccaaaaacagtgaacggtgaaattaaatacaaaagttcagttaccaaaagtttagttacagattgcaagtcaattcatggggaaaattctctttaaaaagaaaagtcttacccaaaaatccatagtgagactgcaagaagcatcgtcccaatcatgacccattcattttttgttactggacccatttcttagcttctcggcagcctaatgctggggc

SEQ ID NO: 434 - DNA, 1311 bp, Zea mays
gcttgaagagtttgggagctggccgttatgaaaaggtggtttgattatgccattcgctcccttagaatttttttaatatggttagaagtacactttttattggcttgtacattctctctaacaatgcctgtcaatatttctcttctactactattaatatctagaacaataggggctgcccatactgtagtgctttaaaaagaagcaatttcagagttattttagaattttgaaaaccatttcattattatgaaagcaagttattttagaacattcaaacacaatcaatgatttttttctgacatgaaaagttcattcatgttttgatgagtttttttaatgcaaattaactttggatcaacatagcaacttagcaagcaatttattctacaacttttttgttctcttttatctgaactttgaagtagtctgtgatgtgggaatagaagagctcaccaagaacatgttggttaacctttattatgtagtttcctcagtttattatttcttgatcccagtccctcgaagagctcacaaagatggcccataatttctatgatgagactgcactcccaaagctggtaagccttgttttagctattttgttaattttctttaaaattttgagtcacttatagcaacattcgctactttagctatcttgtcctgatttgttctttaattaccctataaaaactcttgttatggtacatgatgttgagttagtttacttaatagtatcagagtagtcattcgtcaagcatatatgatcttgggatgttttattcccatagtacttaattcatttttttttcttggaatacatttcgtacaggtggctgatttcgcgtcccttgagctttctcctgtggatggaagaaccatgaccgatttcatgcatacaaggggacttaatatgtcctctttaggacgtgtggtgggtgtaaattttatgcctaaatgcttttcctactatgtttggacaaagttgcataataatctgatattgtttctttatattaatcaggtagagctagcagagaagctcccacacatccagtctatatgcattcatgaaatggttattagatcctttaagcacatcgtccgagctgttattgctgctgttggtgacatgcaaaatatttctgcagctatagctgaaactctaaacatattacttggatctcccagacttgaaaatggtgctgacacagatgcccatattacaatatttgcgtttaaatggtaagagcttcctttcaaaaagattctgctgaaactaaagataattgcacacttcggaaatta

SEQ ID NO: 435 - DNA, 1269 bp, Zea mays
gatcttttaggtaatgatgacatactctgaaatgaaggatttgaaccttgaataatgttcttacagtttgttttttatgcagaacttcagagtcttttgtacccatatgtttgccaagatacaatcctatggcctacttgcatgcttatgttcatttttttgacgtgagtgaaatctatacatgtgaataactgtattggtttaccattcttatcagcacgagatacattgcttacaagaataggtacattaggggtttatgtttgtcattaataaaatgaggacaacatagtttttttttatctcagactacttgggtgtcatctcgagcttgtgcagagacattttgcatttcatagtcccatgctaccacgacctttattgttcttgctgaactctagtttagaaattgtcaatactgaatgctgactggtgacagattaggggattttcatcaatacgtccatttcagggtcactcttcatctataccaccaacaaagctagccaatgacacgttgggtctggttctaaatgttcgtgtttttactggtgttcgagggaaattgagtgtggtattggcagtgaggagacgaggctttgaaaaaaaaaatacagggactagggtagataactaaatcaatgtgttgaggatctgaacaagcagtggaccacagataagagcacactgagatgattctcccccttgtttaatgaacatgacattggacaaaaatgtaggagtaactaggaatttgacctcagccattcatatgcacaatctctcttttcttacataataactggtatagaagctaaaagcattgcagcttaaatgtgggtctcttcttgacaggaacatacatatgtgactttgcttactacacgatcagatgctttttatgatctcaaagattccaggtgagctagctaataaatgactaagcatggtttggatgtcacgaggtgtctgaatgtgtgccaccaaaaataaactgacataacttattcttttgtgaacaatgtctagggcccacattcaaaatgctcttttaaagtcaaatgtcctcatcgaagtccaaagatctttacatgagaatgcattgcgtgttgaggatctcccaaccaacccgtcttctcaatctgcatcacaccctccagagtcctctcaagacattagttcacaatctttgtcttctgaaatggcaattggaggaccaggtggactatggcattttatatataaaagcatttacctgacccagtttgt

SEQ ID NO: 436 - DNA, 499 bp, Zea mays
agagaaagacgtgctgagcaatgtattatatgttccgttgctattctatcctgttatgcataatcctgagctgaactcacatttcttctctttctcatgcttttataggaagtccctctcggcccaacactagattgatatacagagaatttccactgtggcctcccgaaccaagccctctcccactgctaccaccttccttcgttgtacccggattatttcgtgtaaagatcacatgtgatcctaagaattaaaacgtgagtcgttttagcatatattgtgaagcacgtgctggcaagtttccgttcttggcattgggtcaaattggggtgccctgcttccgattccctgctgcaccgtgcctatgtagcatgtaaagttgtatatgctgcgaatcgtagtacagctatatatttgtgtgtcctaaatcttgagtgtctttttactgccttctgtaaatgctccccaactgatgtaaatacaaaattccatgttcctc

SEQ ID NO: 437 - DNA, 741 bp, Zea mays
caaacagctacaaacattgcaacctgacctacctttgagaccatatataaagatcaccaaccagagagaggcaactgactcacaacacaatttgcagctacaaaaccattgtatatgtacggaggtgctattccttgacgtcttcaaagagttcatcttcgtcttcgtcctcgtcgttttctttggcttcatcagaatcgtagctgtcgtactgtaggaggctgccaaagtcgctggattgtgccttgatgagcctctcctggatcctctccttgatggctgtcccctgaggaagttttggaaacaagaatacataaatgagcagtggactcctaatcgaaagcagtggactctctgcgaagggtggtcagagggtaactgaccattgagtggcacccttcctcaaacttctctaagaaaccagccacccagcggtctgcattttccacccactcttcctggagttttgcaaccgtgctccactgtaaacaaacatgagtaattcagaaggctaatggacaaaagggcaccaaccctgtctaaataaagtgagggcttgtttgggtaatcttggattgaggtggtataaggtgtattgaagtgtaatatgaactaatttcttttcaatccctaaaatacctcaatccacttcaatccctctttatccaaacaaagcctgatggggttaaataaacacgatggtagatgcaaataccttctcccctactttttcttggtgcg

SEQ ID NO: 438 - DNA, 464 bp, Zea mays
tctggtagagtccacccatggccggcatgttctgcgccatcatcatggccatggggttgagaccctgggctgccagcagctgctgctgctgctgcatcagagctggctcgtacaggctgctgctggcggcagcggcacgctcaagctgcatcatcatctgcagctgctgcgcgacggactgcacgtccatcatcctcatctgctgctggcagcactgttgccggagcggctggtacatggcgctcgtctgcccacacccggcgtagtagggcgccgccgccagcgggctgcactgcggctgcctcaggtactccgcgtaggggtacagcccgccggcgcccatcatcgtcgtcaggccggcgccagcgccgtacaagccctgcagccccgcgcaggggcagggcatctgcattgcagagacgctggcagctgacagagccaggcacacgacgagaacgatgacc

SEQ ID NO: 439 - DNA, 1190 bp, Zea mays
gaggttgtcagactgctgggacatatgatgagaagaagttgtttggcgtgacaccccttgatgttgttcgtgctaagactttctatgctgggaaggctaatttaccagttaccggtaatagtttgagctttactttaaaattgtggaaataaagaggtatggttttagccttcttctctcactgtctattcctttgtcccccaccccaccccaccagatgtgaatgtccctgttgttggtggtcatgcgggtatcactatcctgccgttgttctcacaggtaatttggctttgattcattttcttaaaagcaatgtttccatgccttgcatattattaaatattaatcctcaatgagaaattataaatcagatctgaaattagtagcattttcttttttcccatccagtattcgataacattttattataccttatatgcctatcacgccaagatagaagaaagatgttcatttgccttagtgagagtaacatctaggtttactatgcatcaaatgcaaatgtattactatctcttgctggaattatgtgacgttggacagccaaactcacttgatgttagctatattcggctgtcagtattcaggaacatcgaatatacttaccttatggagtatattcttgcttttagttgctaatctttggtgatagaaccccttcataccttacttgctttagtataggaatatgaatacggcctacttatgcttaactttattttatccgttgtgaaccatgatattgatgcatggctaaacagtgtgcttttatttctcaacttgtaactttacctgattcaaggaagctttacctgattcaaggaagctttcatttgaaataggccacccctgcaaccaacgcattgtccgatgaagacatcaaggctctcaccaagaggacacaggatggtggaactgaagttgtcgaggcaaaggctgggaagggctctgcaaccttgtccatggcgtaagtcagaaaatgagggaaaaaaactatgcagtctctgcatttcttactgctgtctggctaaatagttttcccctttatctgttttgtaatctatattttcgtactattgcaggtatgctggtgctgtttttgcagatgcatgcttaagggtctcaaggagttccggatattttagtgctctttgttcaatcaactgtaacaa

SEQ ID NO: 440 - DNA, 1269 bp, Zea mays
  misc_feature (1243)..(1243): n is a, c, g, or t
cataaccgtgatcggcactttcgaacaaaaatggatggttgcagcatttcttcaattcaacaacaatgttcaaaagtgatacctgcatatgccatgatcaagtcagtttggtagccaatggccaagtgttgccttgtgcccatgctccagtttgctaggtaatgcacagtgaggtgaggaactgcttgcgctagcaatagcaggtgagaaagaatagtaacattgttccaagcaagataatcctggcaaacaccacagcttttagcaagaaaaacggtcctagactaccagcaacagtatatattcatgtatgaacataagggtcaacttgctacatactgagacaaccaaattacattcaattccaagataaaaaagagcggtaggccggtagctaacaaaaaaaaccaaatgcacccattgaaataactaaaactaaagcctagaatcctacaaaatactcttgaagatgtcaggctgtggagtttagttggggcaacagtccttagaaggttatgccctagtttagggatgttggtctgtatattcctctacccccctccccttcttggctgcctgttcaggcagtttgtgatttggtcgtatacagaccaccccccttttcttcttaatataatgatgcgcagttctcctacgtgtttgagaaaaataacataagccgcagaaaattaaaaaacataagaacttgattaaaagaacaggatgtaacaaaaacctgattcccacggactcctttatttagattctggaaattccgctctaaaatccacttgtagtatctagtaaaaaacaaaaaagtttagcctcaatgtataaacagagcaagttatagctccaggtccatggtccatgcaggatttggagcttgtaggaaaaaaacgaaaggtctaagaatatgggtttgatccaaactaataggaaaacttctttaaaaaaagaggttcaagaaaatcagaatgaagtactcactgtttctgaaggggtgacatctcgacacgtagaatccgttcaattttaggaggtaaagacttctcgacatcttttataacccgccttagaatatgaggcctcaattccttatgcagattcgcaagctataagaaaaccggcaaaagacgttatggttatgagtttcaatcaacggaaaaccaacatattatatgatgttcagtaaatataaagctttcatttggaacactacctcggtttcattgaaggaacntcaaattttgtatctttcaacaaaac

SEQ ID NO: 441 - DNA, 864 bp, Zea mays
tatagcctcacattctgtcgctgtctgttttcagtctatgatggaccctgatccggtgaggcggccttcagcaaaggagatcctgagacacccttcgtttgacaagctccacaaggcctcatcgaagtagaagtgctgccgcgcccccatcagatcagagcagccggcaaagggaattccgcagctgcgtcacattcaccatcagctgctcccaatttttgtgtatctatctatctatctatatgcgtgtgccatgtgccctgttctgatactgtagaagatggttggaaacgaagcagggatctgattttaactccaggaactggagcacgagcagcgtctgtaaaggactaaaaggctgttgctgctgttgtgttaaggttgtgcctctcttttggtttctgatgcacgcttgaaaccatcaaccctgtgcctttttttggggtgcttgttatcagttgcatctggacagcgaatgctaatttggaatttagacgccgaaggcgcggccaaggatcaacacatccagtatatgcgccacctccacatagaggagtcccacccacgccctgccgccgcaccaacagggggcaagactccagcgccgacggcgagcgacggccacaaccagctgcaccgactcgccgagcgaacgagaacaacgttactcaaacgagatgcgatcgctctctgcggttgcgtgccacgacgcggcgccccgcgcggctacgccacagcctacgcgcacaaccccgagggaacaaaagacctgagcacgagcgaccggaaacaattgaagacccctgcggccatttgatggcggcctgcgatgtcagcgggcgggccgcccgccgacggaccgga

SEQ ID NO: 442 - DNA, 867 bp, Zea mays
ggatctggatctaagaagttatggactcctgcccggagtttgctaagaatcccactttgatcaaggtgagaagcgcagaaaatgttagtttatgaccgcgagtccgcgccttgcttctgttcagctccacatatagataaactcgaacgttggctcatgcgtttattgattactatttcgtatatcgtaacatatcttgttatgctgttcttggaatcgaacttgcaacgaaacaatggcaatgtggaactgaagagtaatctaactaaagagcagctcaaggttgtagagtagaggcccatctagtgtcttccttttgcatgtaaaaccttttttttgttcccatcctatgcgctagaatttagatagaagacagagaagggttccacatcatcagtttaactcaatatatgctgtatttgcctgttgtcttctatcgtcgagcgttactgcgtttttatatggtagcagaaaagttattgttttgaccttttgtacttactaggcttgtttttgtagtaacgtaaactaggatgcacgatttgggaagaaggatccatggttacattgcctcatgcacccctttgctttagaacttgtggcactgtaaacaccttgtgtggggggtggggggcttgcacctgccgcttggacatatatatttctaactttgggagtaccatcaacctacattgttgtggtgatattggaaattctcattcatatagtctctaatgcctctcagtaacatgggaaggacctgcttatttgcgaccccatgtgctgcatatttcccttaaagggttattttgaacacatggttttaatctccctcaggtaaagggacccacttcccttagggacttt

SEQ ID NO: 443 - DNA, 853 bp, Zea mays
cctggctttgtttctttagttggagtgcccaaaattctgcattggtagaagagaatctcaaacgtgcaacatgcaacaaactaattgaagtttgaaccaacacttgtaaataagacctgaaaatcttaaacagctcatcgatctcagagtcgccaggaaaaagcgccttctggttcaccatttcagcgaaaatgcaaccaactgaccacacatcaacaggggtggaataatgccttgcaccgagaaggatttcaggcgctctataccaaagcgtcaccacctaataacaagttcagttccaattaaatgatcaaaatctcaaaaggaaaggagcacatgcggagcatcatgtaacagttctatcatatgtaaatgccagccccaatggtgtttgtgccaagtcaaagacaacactaaatttgaaatcacccaagaacaagaacaatgtgacctctagaaaagaactgcactattgccaagcagaagagtgatttttctagaactttccttcttaaaacagcctttgcagtttcatacaaaatcctactaagatatgtatatgcataagcatgtgttctgtttttagcttcgacacttgctctgtcgtgtgcacaggacgaagtaagcaatcctaaggcatactacagaaaagcacacatgaatgacattaccggcagttactaaatatccttcccacaaatacgaaaggcgcgcaaatgagttggacagtggtactggtacgccatgaaaagaaaacacatgcatgcaggctaacgaactggtaattatgatgtgttatgatcactacaactgcaatatcgggtctatcggccagccccatgagtgatttctt

SEQ ID NO: 444 - DNA, 602 bp, Zea mays
taggatcggtgagagtagagacaccaaagacatttaccttgggacctttggtgagtgaagtgctgtaatataccatgtctatcttgtgggatttccaaaggttttctatcaactagaaagcaactgtcagctgatgcagttatctttaattgaaattgactatcggtttgcagaaactgaagaagaggcagcagaagcttatgacattgcagcgatcgagcttcggggtgttcatgcagtcaccaactttgacattagtaattactgtgaagatggtttgagaaaattagaaggcccatcagaggtggctaagcttggaagtccgtcggaggttgtgaagctcgctgggcaatagatactagattagcaacgtgtaaattagtttctatttcgtttcttttgtcttcatattctctcccttttgtattcctgattttttttgccgttttgtgagttccctccttgccttattggcaagccagtatttacccgattcgaaaggacaatgtgatgttgtattttagcctcacagaaaggtattactaacctttgatgtcactgcagaagtcgacaccatgttagaaatttagttcattcgtcat

SEQ ID NO: 445 - DNA, 477 bp, Zea mays
attttggcttgcacctgtttgatccagcagatacagctacagaaacaatcgatgaggatataactgctgagacattcagtgtggagaaactggcaaagttaaaaacaatgtctgaaaaggttgtcatgatgcgtagccatgagtcttctgaaaaggatgaacgagcatttgagatcaatccaaatatgactgatgacagtggaactgtgattagaagggcttctgattctatccgcattgatcctgggctaaatgaagctgcatacctatcctgggtcaagaagttcaaagaggcttccatttctagtgaagatgccacagttggatttggaaggcaaagagcagcgcctgaagaaaagctcctgaaacatgatgttaacaagcaaaaaatagaagaaaagagattggccaaatgggaaagtttgggttaccagacactagcagttaaggaacctgatatcacagcaagccagaatt

SEQ ID NO: 446 - DNA, 1001 bp, Zea mays
  misc_feature (996)..(996): n is a, c, g, or t
aaataactggtggtaaagctggaagaagagatggcccccatttataaagtccaggacaaggtaaagtcggtacttcgtctgccaaaacaggcgagtgattaatactggcaaaaaggatactcaatgtgagatttgaacatggcaacaaagaataagcacgtaaatcacaattgcctacctgaaaggagtacctcagctgcacgacaaaaggatggtcaacctttgtaagtatatctctctcagctttcatgtactcagcatgattcttctccacaatcttgtccttcctcataactttcattgcatatatttcagatgtacctttctttctcacctgatatactttgccaaatgccccttggccaacgagcttcagaacttcgaagtcatctagtccaacgccctcattctccttttttacatcatcaaactcatcatcgctaagggacccttggttgatttgttttcctttggaagggcactctgaaagttccaatgaactctctgtcttgtgtaatgtaagcttgctaaatggcaaagattgactaacaagagatgatggaccaacaagagaatgagatcgtttgacaatgacatcagggtcattgtaaacctcatcgttggactcagctacaggtgctggactgcccggagtgagaatactcacttctgtgtgtgtatggacagcactaggcccaaaaacatcagaaaaatcgaactcaacattttcagaaggcacagcatctgaggacccccctggcagaaggatcttccctctaaaaagcttggagccctgtgcacgcgtcactgtgacagaggttacctcagaggaaaccatcttcgagaacctatgagattccgcaagaagactaggaagtcttgggccacaatttaaggaaggctccttccacacattcccaagacaacggaagatgcagggctgcgaacaatggccttgaacaagtggaaattgacgaaaacaattgggaacccagnaaatc

SEQ ID NO: 447 - DNA, 1226 bp, Zea mays
tcctcctaaagtgcctaccactgccgatgtgccaagtcgtgctcctgccttggtgtcctgcaccggcttggtgtctcctggacgctcaggagattctgtttcatccgatgagacgatgtcgacttgcgactccatgaaaagcccggactttgagtacgtagacaatcaggacacctcgatgctggcttcgttgcagcgacggacaagtgaacatctgcgaatatcagaggatagagatgttgaaggtctgctgaaattcatatacgatttgaattgtttaataagtgtgttttgttatactttttgttgatccagttgctttcttttgcagaaaataagcggaagaaaaatgccgtggccccaatggaaattgaccgcatctgtgatgttgacagtgaatatgaggatccacagctgtgcgctactctggcttctgacatttacatgcacttgcgagaggctgaggtgacacattcttttctaatttctggtgaccaaatggtttcatttgagcactgaacataaggaactttgggttgactgccaacgttgatgcaataagctaggctgcaatatgcttacattaagtctgttagatcgtacttatgtaattgcagttcaacagtgtgggtgtaatttcttattcttatttatgtgaagttttttttgttggtgtattaatgaaacttgatttgatcgaaggactgtctatgttttgttcaatggaactttggcctacacttgaaatttttctttctttcttgatttttactaatagtgctttactttctggcagacgaagaaaagaccgtcaactgatttcatggaaacgattcaaaaagatgtcaacccaagcatgagagcaattctgatagactggctcgtggaagtaagtttttttgttgtctcaaagtaagaaaagcctaaagaacaatcttgtcaacttgtattcattattttctcctcatgcaggttgctgaagaatatcgtcttgttcctgatactttgtacctgacagtcaactacattgaccgttatctttctggcaacgaaatcagccgccaacggctgcaattacttggtgttgcatgcatgcttatagctgcgtaagattctgcttctctttccatttattatccttagttgtcattacgatgttagcgtactgatttggcatgttgggaacttcaaattcagaaaatacgaggagatatgtcccccccccc

SEQ ID NO: 448 - DNA, 1870 bp, Zea mays
aggccacctttataattgataagtatctgtctctctcttctttgaaagggggctaaatgcagctgcaggatccgaggtagaaccaccatttatctggcccagactgccggctaccactgagtcactcaccatgtcgaaatttaatcgactgtttactttcctgccattactgcaaatttaacacgaaatggagtgatataaattagtgttgtagacatgaaatcatgttggacaaaagaaattgtcattttgagattcatactaatttaggcggctatttatagcagccaaatccttagatgggctctgataagcatgggtgccttcaccaatgcatgcataaaaactcctggaacttggtgacagcagtagatccaactgacaagtggcatagaggaatgtgttattggaaaagggaacacggtaaatagttaagtgctatgattcggcagcattactattatgatatgaagtgaacaataaggtggaagtaccattgactagtcttcaaataatttacaataaaatgaaatattgaaatgtggtgataacaagctgtagtatcgaaaggtatgtcaaacctaaggaacttagaaaatgtacatctcaattctcaagaattattcccagcttttaatgaaatgtaaggattaaggagtggcctagaaaaattctaggtattcatcgacacaatacactactgtgttatggctcttgtgagacttaacctctagcctaccccgcgcttgggactcaatggctttgtcattcatgctgttgttgacacattactgtgttgtaaaattttaaacatgcatatgccatattaatcagaaaattattgataaccatactactttaccaaaaacagattggagacaaatgagttatcttacttaagagcaaatataaagaaagtaaagcgaataatgagaagaaaaaccttggtttgccgcaaaggagacacatatacattatgagatgctgaaactttcttcggggacatatctggtaaatttgggaaaggagatggcttgggtgatccaggaatttggcctaagcaacagcaatgacatcattgacttgtaggaaaagaaaaggcaattcaaactgagaaagtgggtataacatataccactagcattcttcttgtcttctggacgagtaccagatgatattaatgacaccaggaaaggcttggctgctggaacaaatacctcattgtaaaaagtaatgatatcaacatggcgtgatattaatacctgttgataagaaataactttcagaaaaagaagcaataaggagcacccaaacaatgaagaactgtcagaatggaagtgcaaatatagaagcatagatacataccccattatgattcctacttccaatatagatgcttaaaaaaacttctggttggcattgtgcttcttttttgtaattgatgagtatctccctgaatgagagttctaattggcaaacctgtcagagaaggcatgatcaaccagcctagataaagggaagtaatgacaggatgctcattaaatagtgtaaacgatacctttgcaacaccataaagacagcaaagaataagttgatcgatgtgtctattaaaaaataatgttgtctgttgatcaagaatctgcttgaagacattatagacacgctctgtctgttccatatattgaatcctttcacacaagtttcttattctaatagcagctaacttcagaatctgaagaaattacaggtcaaaattaaaactttaggaaagaagataaatcataaagatgaagttctgattatgagaaaatccatactttggaaaagaatatatgaattgtcacgtcagcacatttttcgttcccacaca

SEQ ID NO: 449 - DNA, 849 bp, Zea mays
  misc_feature (839)..(839): n is a, c, g, or t
agcattttgatagactggctcgtggaagtaagtttttttttgtctcaaagtaagaaaagcctaaagaacaatcttgtcaacttgtattcattattttcccctcatgcaggttgctgaagaatatcgtcttgttcctgatactttgtacctgacagtcaactacattgaccgttatctttctggcaacgaaatcagccgccaacggctgcaattacttggtgttgcatgcatgcttatagctgcgtaagattctgcttctctttccatttattatccttagttgtcattacgatgttagcgtactgatttggcatgttgggaacttcaaattcagaaaatacgaggagatatgtgcaccacaagtagaagaattctgctacataacagacaatacatatttcagagatgaggtttgtgacatgtttacttcctatcgttctttaaaaaaatacagcagaccatatcgaatagtcccttgtttgtcactgtcactaaataacttgtacgttaacaggttctagatatggaagcttctgtactgaattacttgaagtttgaaatgacagcacctacagcaaagtgctttttgaggtgattatccccgttttttattttagaaataaatataatgattattctaatctaacttgccactaactcttatcttttctttttttgcttacaataggagatttgctcgtgctgcacaagcgtgtgatgaggtactgctatatagtcagcttctggttactggaaggaattcctcaagttacagatatgagaacaattcgctgacaatctctctttgtacaggatcctgctttcatctgagtcccgcnccaaaaaaaa

SEQ ID NO: 450 - DNA, 623 bp, Zea mays
tttttttggtcaaggaccgcaagtacccgacggggctgaaggcgaaccgggccacggagtcgggctactggaaggcgacggggaaggacagggagatcttcaggggcaaggcactcgtcggcatgaagaagacgctcgtcttctacacggggagggccccgaggggaggcaagaccggctgggtcatgcacgagtaccgcctccaaggcaagcacgccgccgccgccaccagtagcagcctcgtcgtcccgtcgtcggtcagagctggcgcgtcgtcaaaggtacgtacggtgctagctttttttttgttgcttgcgcgtgcatgttacgtaccggtcgatccatccatccatccatcggttgcggttggttggtcgagacacagcgagtggcgtgtggatccgtctaactccatctgtgctgtgtctgtgtgtgtgccttgccgctgcactactacatgctcgcagcaggacgagtgggtgctgtgcagggtgttcaagaagagcatcgagccgccatccgtgcccggcagcaagaggtcatcgtcggttgcgtgcatggggacggagggcacgggagtgggagtggggccgtcgtccatgtccacaagggaacgacttcga

SEQ ID NO: 451 - DNA, 732 bp, Zea mays
atcgcagaagtagtaaaggagaagataaagctgccaacatatttatctagtgaagttcactcaatgttgaaaggagtaagttgctgctatgtctaccttgctcctatgcattttgttcaaccagctttgtgttattgttaaaacctactgtttacggccatcactctaccattcgatctcataatgtttccattttttgtggataatcatcctgccatgatcatgtcatatttctcaacactgttatttatttcagttattgcacaaagaagctggcagacggctgggaagcggaccaggcggcagtgacgaaatcaagaaccacaagtggttcaagtctgtaaactggaagaggctggaggcccggcagatcgagccaagcttccggccgaatgttgctggcaagacctgcattgcgaactttgacgagtgctggacgaacatgcccgtgcttgattctccggtggccagccctgttgcggccaacagcaactttgtggggttcagttatgtgaggcccgcaccgttcctccagaagccgagtccccttggctaaagaactacttccgtgatctgatatctaccccagagttcaaataactatctttgagtccgaatcctatgtatttcttcaagacattagtgatgggaatctaaccttattgttgtgttgtgggtaggccagccaagcgcctattgcttgagaacaacagctggcaagtgacatggcaa

SEQ ID NO: 452 - DNA, 1330 bp, Zea mays
cggaaagagatccagggtccattttcttctcgatgatcagaagaccgatactgaaaaatatgccccagtagttaacattgacaaggtactatgctgctgcagagcacttcattttgcaacttgaaaaggttgagataaacttctgtattgtgcaaacaaatttataatgttgcaatttagtgtgtatatagatatgtttttattgtaattttgcacttgtcgaattttatgttatttgttcgactccaaatttatatatgaatagcctatctatcaagagcttaatgctctaatttttctctcccacttaggcatttgagtcccccaacactcatgctgagtgcttcacatatctgcggcaatacgcggagaattgttctgcgaaggctgcttgtatggtggcacctaagagcatcatctcctacccacaggtttcaactcacctactcctgctcttgttttgctgagctatacgtccacaatgcgtcgctgctagcttcacacttttttgttgcttttcatgacaagttggtgttgagcattgtcagtattggcacttcagagtttagattggagaggaaggctaacacgttgtatcacgaacacaggtctggaaagggcaagggtcgaggaagtggaagcttgaccagagcgacgggttcttcgtgcaattcgaggcaccggcgctgaggaagatatggtttgtgccaagcacaaaagagaagggacggacattgtgcaggtaaatctctctctccctcccccttttttttcctacttgacagttctaaagtagtcggttcagaactagtttcagcttccaaaaccagtgtcttctaaaattaaaatgctgtccatgcgctgccgtactgctcaccttgttcagacgatcatgcttactagagtaggaccaagaccaacaagtgaactgtgcctgtaatcgcaaatggaaaacagaaacggcaaaccttgtcatccaccttccaccatgaaaagcctcacgtccttccctctttatggtagtcacaagaggtaggacaacgtactgtactgtactgactggagtacatcgcgctccccctctttattgcccgtgcacgcaggagccctgaggccttggacatcggcatccatgaagtgctcccccgtatattcaaggaggcagcttaagcccaataatggaggactgtccatggattcctgatcctgcacagcgcttgctggatgttctccctgggacctgggaggaggaaagagctcgcccgacatacatttgtgtaaccagtggaatcggctacgctggcagacgcagactcggaagattgatcgt

SEQ ID NO: 453 - DNA, 535 bp, Zea mays
gttgccagggcacttgtcaccactactgatgccattggctaccatgaacccatggatgcagtactgcatgaagcaacagggggttgccaacttgttagcgtggccgaccctgatgatgcagcaactgttggcctcaccgcttcagccgtgccagatgccaatgatgatgccgggtatgatgccaccgatgccgatgatgccgatgccgagtatgatgtcatcaatgatggtgccgactatgatgtcaccaatgacgatggctagtatgatgccaccgatgatgatgccaagcatgatttcaccaatgatgatgccgagtatgatgtcttcgatgataatgccttcgatgatgatgccgaccatgatgtcaccaatgatgatgacgagtatgataccaccgatgatgatgccgagcatggtgtcaccaatgatgatgccaaacatgatgacagtgccacaatgttactctgattccatctcgcacattatacaacaacaacaattaccattcatggttgagcccacatgttgagcc

SEQ ID NO: 454 - DNA, 471 bp, Zea mays
tagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtg

SEQ ID NO: 455 - DNA, 1064 bp, Zea mays
tagctttagagcatgtggaaatttcagcttctggacaggctactaacttccctacttgcacgcaagcataaggtatggttttaatgaacatgttacccaagtttgtgtttttttagtatttcttaactaactttagatcaactgatatatgtttgtaggttctaatattctcacaatggacaaaagttttggacattcttgagtattacctagattcaaaaggccttggggtttgcagaattgatggtagtgttaatttggaagagaggcggcggcaggtaacatgctagcctgtgccaatatattactcctttcattccaaattataaaatattgacttttctagatacattacttttgctatgtatctagatatacactcatgtgggagcctccaacactggatctgccctagatacacactaagtctatatgcataacaaaaagtgatgtatctagaaaagccaaaacgtcttgtaatttgggacgtgtactatttttctaaagaacatctaaactctgaggatttgcactgtagttagatatttgggtacatgtataaatttatttcacaaaaaaaatcttttgttactgttttctgttgcagatagcagagtttaatgatttgaatagcagtctgaatgtctttattctgagcacacgggctggcggacttggtatcaaccttacttctgctgatacatgtatcctttatgacagtgactgggtaattctctgtcaagactactatactcatcagaaaaatgtttacaagaaagcctttttttttgctggctactttctttggctgctgattgacttattatgctagttctaatatggtgctcgtttactcgaacctccagaatcctcagatggatcagcaggccatggatcgatgccaccggattggtcaaacacgcccagtacatgtatataggctggctacctcatattctgttgaggtatgcttcagtgatccgtgttttcagacttgtcactttggctattgtctcaggtttactcagcttttcacctttgcaggaacggatcatcaagaaagc

SEQ ID NO: 456 - DNA, 909 bp, Zea mays
  misc_feature (593)..(593): n is a, c, g, or t
  misc_feature (595)..(597): n is a, c, g, or t
  misc_feature (599)..(600): n is a, c, g, or t
attatacagcactgaggctgcaaaggacatgggtgctaagaagtacaagtaccccgatgtatacgacccctacgggcctatgccgccgccttcggagaaagtcgtggaactagctgatcgcatcgctgctctccctcccgaggagatcaaacagattgctccagcccttctcctcagactgaaccaggagccgccacaggcggtatctggccagggtttcggtttcggtgcccaggtcggctctggggcaggttctggaaaggctgaggagaagaaagccgagaagacagtcttcgatgtcaggttggagaagttcgatgctgctgcgaagatcaagatcatcaaggagatcaggacgtttacggatctggggctgaaggaggccaaggagctggtggagaaggccccggtcgttctgaagcaatcgctcacaaaggaggaagcggaagcaatcatagcgaagataaaggcagctggcggtgttgctgtgatggagtgaatgatagatgatcatctagacatcacgccttcttttttgtttcatatttttgttgccatgttcaggtatttgagatgccacccattgcaggacncnnncnncccccaacaccaatcctccctcccctcctcctccataccatactcctaccttcttttctcacttattttcctccccttcacactttcccaccctcaccaaccatctctctccccctctcccctctctctccccttcctcccccctcctccccctctctcactcccttccccccccaacctcctcccccctccaccctactcccctcaccttcccccctctaccccactcccatcctctcccctctctcctcccacctcctttcactacctcccttcctttaactcattcccttacccttccccctctct

SEQ ID NO: 457 - DNA, 984 bp, Zea mays
gcggtggggcctggccgacttcgccgccgccgtcaaggaagccggcgtgcacggcctcatagttcccgacctcccgtatgggaactcgtgtgctctcactctcaggaccgaagccatcaagaacagcctcgagctggtatgtgacatcaattatcaaggagaagcacgtggcgtcgtctcctagtctagttcttctgcgcaatataaaattgagaaagcagcgtctgtctcacgacatgaacaatggctgaacgcatgcaggtgctgctcacaacaccatctacgccagcggacaggatgggggagataacacgagcttcacgaggattcgtctatctcgtaagtgacacaaaactttccgtccaggagttttgctagcgactgaacttgccggccgatgacatgcatgcatgctcatgtatcctacttgaccatcacaggcgaccgtcaatggagttacaggtccacgcgcaaacgtgaacacacgtgtccagtctctcattcaggaggttaaacaggtaataatacgtcttggcgtcttgccaaaggaaaaggagagaaaagagagggagagagaaaaagatgccatttttattcgtttttgttgttaccaatcacaatcactgagctggctggctggcttgtgtttttttgtttgctgcaggtcactgacatacccgtggctgtcgggtttggcatatcgaaacctgagcatgtaaagcaggtaggcaaaactttttttttaaaaaaaatgcctcaaaaacttattcacatattttttttatagtaacaaattctaacagtatatatattgcacctggacagattgcagagtggggtgcagatggtgtgatcattggtagcgcaatggtgagacagttaggcgaagcagcctctcccaaggaaggattgaagaggctagagaaatacgccaggagcatgaagaacgcgctaccatgccagtgaactagtcgtatgacgcga

SEQ ID NO: 458 - DNA, 1667 bp, Zea mays
ttatttttaagtggctcgggtaagtagctcaatgatgccgagaatttaattggtattgaacaaaggatgtctctgtatttgtggaaagcaaatgcgagctgtattgctcatccctcttttgcattagatgcctgtgtggacagtgtggtggactgtactgcataggtagcattctagtttttgcttaattgaatggtagttattttggtttacaaggtatagcttaagaaagtctggttcactatttttcattttggctggtatatttacacagcacactattcagctagtcccttctctaggacaaaaaaatcatgtcttttttgcgtgccaatatcatatattcaatctgataaatatccagtaaagcagtaagctcagctggagtttccatacatgtcataaatatttaaccatactcggccacaaaataaaccctatataacatattattaaatttgaatatttcttgcaaaaagttctcatcttttgtggggtccttcgagttatattttttgattgccaataagcctcactgttggttctcttattatgcaggccccatggtagtgattgtggcatagtgaatgtgaacatacctactaatggtgctgaaattggtggagcatttggtggagaaaaagcaactggtggtggacgagaagcagggagtgattcctggaagcagtacatgaggagggcgacttggtaagagtatacacatttttgctgtgattgtatttgaaatggtactatatataatcattattagagcagtgcatagtaagggtagttgcataatttgatatataaatatactggcatgccaattgccagtttgccacatgtcacactgagtttaagattgaagagtaggtgatgattatttagttagatgtccttgttgtactcaactatcttcagccaggctagtttcttgcttatagggcgctggagacccagccctagtctagggtttggttgtttggctccagcctttttactgcacactttgcaactgcaagtctgcaacacatctttactggatattctttttagtatgtactacctccgttttcgaatatttatcgttcgctagttcatttttaaactaaaatgcgacaaatagaaaagaacggaaggagtagtaaaataacgaatatacatgagaattacatgcattacaagtaccctttgttctgaacttctgattgtcccactcatctgtgggttggtatttgtaacgattcgttactgcaaaggttgcaagttttctgtcgaaaggacaattttcagttcgattttttttactaacacccattctacacatttgcagtacaatcaactatgggagcgagctacctctagcccagggaatcaattttggttaatcctgcagaaatgttgcgcgtggatctcagtgttttctgcagacgtggatgccgtacggaaagaactgatgcaaccgcatttgagatctcagcagacttgagcagcatttattggcgtcagttgtgaaacttaaactgcaggagcatcttgtacataaataaaataagatgtttgttgctcgtgggccgtggcacgttttggtaccggtgtccagtctactaataaaatctaatgcaaaacggtcataactacattctcatgcagtagatttccgc

SEQ ID NO: 459 - DNA, 801 bp, Zea mays
agcaaattggtcacatttggaaggttctggcggtagaaagcctcacgaagagcacggactttatcggttctcgtaatcaacagatggaacagtgcaatgacagccccttcgaattcagcgccacgaccactgttgatggttgtggggctaaatgccttccagatgatattctcactacatgaaagcagtcttattataagactaagtggaacagaacattacatcaatctaatatcaacatcaataaaaggattaaatccaacatgcttaccagatattggtagcaatgaacagagaaataccagatcccaaaccataacctttctggagaagttcatccaaacagatgacaatgatgccagcaaagaaaagctgaagtataatgagaatagcattccctgttccaagttggcttacactaccatacattccagacaggacatatgccacagcttccccaatagcgatcaagataccaagcaacttttgtgcaccattcctgagtaaagaaatgcaatgtgcatcacaatacaaatatattaaatacagatcagaaggtttataatctactatggcagacttgatagagaaatgctacgattagaattgtgataattgaagatcacaatatttttagaaagacaacacttacagcagagcacgatcctctctcacactgttgtcaacttcaatgatcttcgatccgacaagaagttgcattaccataccagaggtcacaattggagtaatacccaactccatcacagtgccacggtttgatgcaaggataacacgcatcca

SEQ ID NO: 460 - DNA, 888 bp, Zea mays
  misc_feature (590)..(590): n is a, c, g, or t
tcttcttggagtcggagcctggagtcaccatgttgggcttcaggagggtaccctccaggaggacatggtgctcgttgagcgccttgtagcaggcagcaaggacggtctcagtgacgtaagcgcagcgatcaatgtcatgagggccatcaacaaggatctcaggctcaacaattggcaccagaccattctcctggcagatgatggcatagcgagccagaccctgagcgttcaggtcgatggcaagctgtgatggctcattagggccaatcttgagaacagcgcgccacttggcaaagcgggcacctgcctcgtagtacttggcgcaacgcttgccaaggtcgtcatggccttgggtggtggtctccttatcagtgccaacaacctcaatggtgcccttgtcaaccttgatgccagggaggacgcctccctccttgaggacatcaacaaaaggcttgccatccttggtcttctggtacagggtctcctcgaagaggatcacaccgctgatgtactggagagcaccagggcagcagaataggagctcacggagggcacggcggttctcttcaacgttctcgacattaaaacantacccccctaccaccttacaacatacaataagtgcacacaacaccaatatcccccaccacccccccactactatccacccgtaagcacccccaaaccccctaacatccctccccaacccacatatttacgtccccctaccccccccaaattagtaaacccccccacctccaccacccgccccccaattccacccccccatataccccacccccccccccatcccccaccctaaccaccgattacccggtcatggacaacacccaagacaaccgaccgcacacccccccaccccccccc

SEQ ID NO: 461 - DNA, 565 bp, Zea mays
cgttcctgtgtacgttatacaacagctcggcgcatgtgtctgtatgcattatgcaagcacatgcatgggcatctaccgatgaccacctacaatgctgcggtggtggcggcgcccttggcctccgccgccttcctctccttggcggcgtcgacaaacccgacgtacaggtccgagtgccccgtgtcacaccgcggcagcgctggcctcgcgccaccgtcggccatagccctgacgaaggacacgaaccgcccccagttgtcgccgtcgaagagcgtcttgttcatgcgcagatacgtgaacgcggccaggcctgcgccgcgcgccgtcgacaccacctgcgagaacgccgcatcgtcgtaccgctccagcgcgttctcgccggcgagctgcacgccggcggcgctggtcgcagccttgacctgctgcaccagcagctcgggggagcagctggcgtgctgcggctgctgctcgtccttcatctccatgcacgtgaagttgagcacagcgccgcgcttggccagcatgcgcgcgatcggcgcgtacccgtcgtggccccgcgtgttga

SEQ ID NO: 462 - DNA, 1444 bp, Zea mays
atgattacttattcctctgcccatttaactgttacaccgcagtttagtcgagcaaatttcgaactacaccataattggaactgtaaaagcaaatcctatgatggcaccataggaaaaactgctcagttttcaagcgctataaggattatacatagccaataagtttcggcctaggcaaaaaaattggcaaaaacgtgccctagtagacaacagcatagcctgattgtctaatcatccagctcaatgatcttcaccacagaggaatcacccactttctggcaaacgacgacgcggtcgtgggacttgatcacgcccgaggctttgccatggtcaagagcaaccttcaacacagactcatttgtagcactggtagattcagcctgaaagatacaatggagattgattaatgccaagtcaccagatagccatcgttcgttcagtcaggtatcaatcaatcagtttgccccaccgaatttgaaatatatgaaaactatttaagaacgataatacgtgacaagttagaggtaacaacaattgagtttcaatcttagcatacaccagcttgcttgggactaaaggctcgataaaccatacttatcataccatgcaaactgtttgaaactaaactactgaactgcattctagtgttcttgccttgaaacatggtgtgaaacccaatggaagcaagaaccattaaacatgatatagttatgttaataaaggttgatatatacatgtacgaaccctagtttcatactactaactaaaaatcgtcaaactgtcttgagacatcttattaccatagaagagttgaaacaacgctagacttcaaagaatacaatgatgctaatcccatatattggctacacgtaggaaatcagaagtttgtgttgcaattatagtatatacttaaatccctctaataaatgagatgtttaacttactgggtgtcgtggatcagcaagcatagggaagaggcctctaactatgagtgattgtcttgcctgcaagaaatcatacaaaaaaatgagtcatatagtaccaaatattagcacaatccactgacaaacagaaaaggaagttgaatggttatatgtttaatgtcaataagctaaactttgcacaggcagtaattcagaaataaatggtcaacatgctaataacaatatgagaacccaacattgcatagatatgttgtgaagatcacaaacacagttcaaaaggaaaaaaagttgttcacgcacctcaaaaacacctgtgaaactccacctcagttggtttgtctttagacgaggaatgacaacagacaaaacaggcatgctgggcctgtacttagcaatgagcctgcaaatcatttagatatacatgagactaattttcattgaacttaaactacagccctgtataagcaatattcatttgtatatatatatacctgcagctc

SEQ ID NO: 463 - DNA, 1001 bp, Zea mays
atgtcgctggtgatcctcctgcccttcgccgtcgccatggaggggcccaaggtgtgggcagcgggctggcagacagcagtcgccgagatcggtcccaacttcgtctggtaagctcacatgctagctccttggaccacactcacatgctggctgccatgctagctgtttaagatttcgtgtgttcattacccggaattcccaagcctcggatcattcttaaacacggtctgctcactgatctgtgtcaaaagtatctagcattgcctcccgtctcccgaaaagagcagttgcgtgtgtagggaggggcagagcatggtaccgagatatgatatgatatgaattgtatggtctgcaatagtctggtcgtctcgcaggagcagaatcgattatcgcttcgatatttccgtgatatatcaatccagagctgggttcgtgtggctaaattaaaggcttcctctgtgcgtgtgcgtggacgcaggtgggtggcggcgcagagcgtgttctaccacctgtacaaccaggtgtcctacatgtccctggacgagatctcgccgctcaccttctccatcggcaacaccatgaagcgcatctccgtcatcgtcgcgtccatcatcatcttccagacgcccgtccagcccatcaacgcgctcggggccgccatcgccatcctcggaaccttcatctactcccaggtaatagctccactccacacggtatgtttcgaattttgatatcacaaacgctgagttctgacgaaaccgttggacgttccaggccaagcagtagccgcccttggcgcgcgcgtctggctctcaggcctcagttcagttcaccgccgaatcagctcggcgctcgaagatataacagattatataacttttgaggatatctacctagcttgtataatagtattattactagatcctctcttcttttttttccgtattttcttttttcctaggactagcttattactagatcatttcgtcgtcgtgtttcac

SEQ ID NO: 464 - DNA, 1533 bp, Zea mays
tgatcccggtagtgcatatctcctatgctatcatgctgtggcttctaccattatttcccatgctaagattaatactgctgttgctgcctttttttttctcttaacccaacgaatcactgtagtgtattgcttagctatctataacatatttgcgaaagggcctctagcgttatggttaaggcttccgagtagcacctccagttcccgggttcgatccccatcgggggcgaatttcgggcttggttaaaaaaatcctctcgctgtgccccacccgctcccgggttacatcctgcgcgccaccctccggctgggccgttgtagagtgggcggtgacggcccgctagtgatgggggccacggttcggggattttctcggccgggaccatgtttcggtcttttcttaatataataccaggagagcggtctttcctttcttggccgagtttttttatctataacatatttcttgtgggtgaaacttttgagtataaaatctattattttggtttcacgtttttacgacctcttcatttatccttcaatagagaaaatgtgttctgaaacgcaacttgttaacctttatgttgacactttcgcgaatttcaatattttacaggtggtgctagcatctctctaacatacattgcatctgaaagggcgattcctgggtaactattctgttgagctttttgcaacggggctaatttttatgctatggcaccttgtgactgttatattgagtttgttctctcataggtatggtggtgggatgagttctgctaaagcagctcttgagagtgatacacgggtatggtgttgcataattgtgtgcttaaattcttccttttcccaagaattcattttctcttttacgtttataaacctgccgatataggtgcttgcattcgaagctgggcgaaaaggcaaaatcagagttaacaccatatcagcaggtacttttatcacgtaatactgttgaagtaaaaggaatattagcagtaaaacttttttggtgagctattcctctatgccgtgacaattatcctacacctgtacctataggccctcttgggagccgagctgctaaggcaattggatttattgagaagatgatagagtactcatatgttaatgcaccattgcagaaggagctgttggctggtcagagttttgactcctccctttgttacttgtgacttgctgtttcatccccctatttgaaaggtggcaacctttttcttcacagtgctctcttttttcttaacaagtatgctcttgttgaacagatgaggtggggaacacagctgcattcctggtttcttcattggcttctgccatcaccggctcgactgtttatgttgacaatgggctcaatacaatggggcttgcaattgacagccctaccataacgtcatagatgtggttgtggtagatagacgacctttcctgctgcattgcggtatcatccttgaataaagatcatagttagttattagtatgagaggtaagggcaggaaagggggaaaattataa

SEQ ID NO: 465 - DNA, 1673 bp, Zea mays
taatcaggtggttatgacatgcttggtcgtacaagggatcagatcagaacaaccgagcaggtaaaggcaacaataggtacatgtcaggcattgaagttggacgctcttgttataattggaggtattgtttcttatgtttgtttgctgagttttatctatgatttaaatcagatacaagctcataacgtctttctttgctctttaattgaaggtgtcacatccaacacggatgctgctcagcttgctgagacatttgctcagttgaaatgtccaacaaaggttggatgatatttgctttggattttttagttccttgattatttcgaacagaagcctatatttttcatatgtaaacaatctaacaatactatttgagcaggtagttggtgttcctgtaactctaaatggagatctcaagaaccaatttgttgaaacaacagttggttttgataccatatgcaaggtaaagaatttcataagtcaaactatggagttgcatccttcatcttgcatgtatgttgtagatcatttttcattacattttcttagtaattccctagtacttcttggtcaccttcggacaccacaactccataagtgtgcttaccaaggtagataatgagtaattttgttgtagtttagcatatagagaatttagtgctacatctgtgttgaatctcttagagtatttattgtagtaagtttgagttgtgatgcttttataacttctacctttctatcaggtgaactcgcagttaataagcaatgcatgcatagatgctctttctgctgaaaaggtaagatgcaccagatatcatcttaacatacatttgattattgggaacgctttattggttctatgggaagaaaagagtgcgatatttcaatatagatattctattacaaaacaaaaacttatttatgctcttgagaagaaataggacaaccaaccttttcaatttgacctgtgattggaagatgccatcactggatggttgttctaacactgcagcatttactctaattgaggagacactttctgggatctatcaactaaactagcttatggaacttaaaccattctgtcagagctttaaatatcataacttagaatcagtgtacacaatttatttttagtttctactttttcatataccacatactgagatccctacataaaatttgtgattttctgatacaaataaaatgtgcgctcattatttgtatttcttagccaccataaatctcattttttttctttttctcagtattactattttattcggatgatgggacgtaaagcatctcatgtagcattggaatgtgctcttcagtcacatccaaatatggtcaggaatcctgttatcccgttgtatatatatatgtccggttgatttacatacaaaattatctggattcatatcaactcaactatgttcaggttatcctaggcgaggaggtttctgcgttaaaacttacaatatttgatattacaaagcagatatgtgatgctgtgcaggcaagagctgaaaaaggtaggaactactaagtgatctgtaacacagtccctgtagtcattaactcattattaggtgcacttattcctgacgatggtattttcttgggcagacaaatatcatggagttgtacttattcctgagggcctgttagag

SEQ ID NO: 466 - DNA, 1495 bp, Zea mays
gctgtctgatgaggataaggatgtaagcagcaactctcgaaagtgtgattttatgtgtccttgtgtaactgttgcttcgagtttgatgtatccacttcctttcagaatttaacctttaacagcatgagaattctgggtccgaactataatttgctgtagaagttccagccgtgtccttaggcccatgctaggacttactttcgtgaactgattttcaggttatcaaaaaatggggtgctccaaataagattgacttcctctctctgtcttacacaagacatgcagaagatgtgcggcaggtaagcaattaatgacattatggatgcattttcacttattttgtttgttctctataattgttgtgcttctaaacaatacaaacatttttgttaatgagaaggttgcttagctatatttgaatacagtgtctccactttgtgggagaagaatggtgttaacagtgctagtgtttttgtcccctgcaatacaggcacgtgagttcctctcgaaattgggtgatcttagccaaactcagatctttgccaaaattgagaatgttgaggtattttcgagttggtttctttctttttcattgttagcttatgtatctctgacatctacccacttattgctttgcagggcttgaaccattttgatgaaatactggcagaggcagatggtatcattctgtcaagaggaaaccttggaattgaccttccacctgagaaggtttgctttctcaactaacattgtatcagttcagaagacctcaatttagacatacactagtacccaaaaaaacctaagctgttaaaggaaataaatacaatatagcatgtacatcagcatttactgacataaccttaaacattttatttcatattaatatttttttattgttttaagatgcaacaattgtccttttttataccagttcatttagcctttgatctttacctctctaggttctccatattgtaggtctttttgtttcaaaagtctgcgcttcacaagtgcaacatggctggaaagcctgctgttgttactcgtgtcgtggacagcatgactgacaacctcagacctactcgcgcagaggcaactgatgtggcaaatgcagttcttgacggtaagttcttgacaatctttggtggactctggcttttgtagcctaacatactggtccatggtgcacttagaaagaacagtctaatcatgatgcacaattttatttttacttcagggagtgacgccattctccttggtgctgagactctccgtggtttatatccagtggagactatttcaacagtgggcagaatttgtgctgaggtaaaatttctattgagttttatgttttcttgatgaaggatttatctttacttctgtgtgtactttcttttgcttttcatctggcttttcattgatcagttcattatacaatgtttgtcaattgttttacaggcagagaaggtatcaaccaagattttactcaagc

SEQ ID NO: 467 - DNA, 841 bp, Zea mays
tggtggtttaattctattcacttgtcccatatatttggtggtttaattctatataacgaacacctaaatcataggagtactaacaacacagaaacacataacaaaactgcaacctcaccacaagcagcaaaaagctaatctcaggtcccatattagcgagcggatctgccacagatgatggcagaaatggaaacaaaagtgcaaaacatgtccagactcagcatgaacctggcgacccagaggcacgcgccatccacatttattctcggcatacacaagcagcaaccatccatgagaagcagggggaaaaaacccctctactgggtcttgaacatgtggcggatcaggtcgacgacgcggttgctgtagccccactcgttgtcgtaccacgagacaagcttgacgaagtggtcgttcagagcgatcccggccttggcgtcgaagatgctcgacctgagtgggaaaaaggcagaatgacaaaaatgaatcatggcggaacactgcgaattccgtagtagcacagtttcgttagttggttcctaaatgatagaagcaaagccatacctgctgtcaccaaggaagtcggtagaaaccagatcctcctccacataacccatgatacccttgagtggaccctcggaagcagccctgtaatcaacagcaagcattaccaaacatatatggagagaactactatagatcaagatagacgcagtgaaacatagacactgaacatgtggtagtggcgattaatccaacaaggagtgtttattaccttcagacattggtttagaaataaattgagtggttattaaaagaaataaattgttgatcacttact

SEQ ID NO: 468 - DNA, 1498 bp, Zea mays
cgtcgcttgagataatcttggttgataccttctctgcctgtaaaacaattgacaaacattgtataatgaactgatcaatgaaaagccagatgaaaagcaaaagaaagtacacacagaagtaaagataaatccttcatcaagaaaacataaaactcaatagaaattttacctcagcacaaattctgcccactgttgaaatagtctccactggatataaaccacggagagtctcagcaccaaggagaatggcgtcactccctgaagtaaaaataaaattgtgcatcatgattagactgttctttctaagtgcaccatggaccagtatgttaggctacaaaagccagagtccaccaaagattgtcaagaacttaccgtcaagaactgcatttgccacatcagttgcctctgcgcgagtaggtctgaggttgtcagtcatgctgtccacgacacgagtaacaacagcaggctttccagccatgttgcacttgtgaagcgcagacttttgaaacaaaaagacctacaatatggagaacctagagaggtaaagatcaaaggctaaatgaactggtataaaaaaggacaattgttgcatcttaaaacaataaaaaaatattaatatgaaataaaatgtttaaggttatgtcagtaaatgctgatgtacatgctatattgtatttatttcctttaacagcttaggtttttttgggtactagtgtatgtctaaattgaggtcttctgaactgatacaatgttagttgagaaagcaaaccttctcaggtggaaggtcaattccaaggtttcctcttgacagaatgataccatctgcctctgccagtatttcatcaaaatggttcaagccctgcaaagcaataagtgggtagatgtcagagatacataagctaacaatgaaaaagaaagaaaccaactcgaaaatacctcaacattctcaattttggcaaagatctgagtttggctaagatcacccaatttcgagaggaactcacgtgcctgtattgcaggggacaaaaacactagcactgttaacaccattcttctcccacaaagtggagacactgtattcaaatatagctaagcaaccttctcattaacaaaaatgtttgtattgtttagaagcacaacaattatagagaacaaacaaaataagtgaaaatgcatccataatgtcattaattgcttacctgccgcacatcttctgcatgtcttgtgtaagacagagagaggaagtcaatcttatttggagcaccccattttttgataacctgaaaatcagttcacgaaagtaagtcctagcatgggcctaaggacacggctggaacttctacagcaaattatagttcggacccagaattctcatgctgttaaaggttaaattctgaaaggaagtggatacatcaaactcgaagcaacagttacacaaggacacataaaatcacactttcgagagttgctgcttacatccttatcctcatcagacagc

SEQ ID NO: 469 - DNA, 390 bp, Zea mays
tttgtgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggcaggtgcccgctttgccaagtggcgcgctgttctcaagattggccctaatgagccatcacagtgga

SEQ ID NO: 470 - DNA, 1348 bp, Zea mays
ctcagggaactgcatgcatgcacgacagtatagtgattttttttgttagttgcagtgctgatgtcatactatgaatatatataatatatatacatgacgatatttacctcttcgatactggtaaatgacgattccgctgaaatttcagaaactccagaagccagcagatggcgagcacgctcgcgtgtgttgtacagcttgtcccttacatggcctagtatcacccggtagggctcgtttggaggaatttgcttccagaattctgcgccagcaaatacacttcagaaaagatgccaaaagagccctcaaattaatttgaaaacactagtggagacttttgcaaaaggctgtacggcaggcaaaaattaagcaaacataaatgcttctgtttgtggttacctatgtaatacttggtaactttggaaccagacgaactgtggagctcttcggcacgaacacgaagctcatcgttgcagcgccacatagagagctacagatatatcagacgatgcatgcatgagagttctggtatggaccggagacagcaaaaaacagggcaagcaaaaaaatcatagagcattcaatcaaacaaatctgcagtatggatgtacagtacctcaaacatcagctcttcaatctgatcgatgtacaagtttgcagccatcattctggccagcaagcatacatctcttgtcacctccggggtaactcttggatttcctatatagcgatagattgcaaagatatacaggcttagaaaaaacatataattctgtatatataattttctggcgagaaaagaaaaacgttagccttgaatattgacaggacaagtactgatataatataagcactctttgatatataaaataatactacacgtataattctgtgatataaaaaattcaacaagttaggttccaggttgcaatataaagatttgattaaattatgcttatatgttgtgctagcatgtatggatgataattttttattagtgaggtgtactaaataatttcaattttaaaattctagctcacgagagctcgaaatgatagactagtttttctgaacatctattgcagttagagtaaagcaggaaggtttctctcaagccaaaagacagagtaaagctcctgccactttattgaaaaaggtaggcagaaatgtaccatcgcggtcaccacccatccaagaagagaaccgaatgagagaaacattgtagggaaggcgctcattgatgccgatattcttcagggctgtatccacacggcgcaagaacttaggcacgcccttccatacagtctcatggagtagctcatcccatagcgcatttcgtcctgggggg

SEQ ID NO: 471 - DNA, 1300 bp, Zea mays
tctgtcggccactgcggaagtacagggtacgtcccatcgtctcctcctccccccctgtcgtgatcgtatcctcgttcgttgctgatcttcgttgctgatctgcttgtgatgcctttaggtctcgtgtatcgtagatctgtttagttgtttcgttgttggtgcgctcagatctcgctgtgattgatgggtatgctaaggctaacggctatatggacgggagaacactctttgtagactgtactgtccacagatcggagtttgaaatggaatgtgtggacagaaatctggtggcctagcctaacgattcgtataggtctgagagactcgttcagttgtaggatttgtggattttttttagatccgtacaggattgtgctgtcgtgtgcccgccaggggcttggtggttgccaaaaggtgatgcctctgatcggttaatttggatatgggatttgcttactttttgcttcgattttatacatacatatagtggtatgcatctgctcgtcctgtttccagttgatgaaacatattctcctgctagcaagttttatacaaaaatagagggactagtttttatatggtcgtttcaaattatatatagcctgtttgttcaatctaaatatatttgcctgttgtttcatggctactagaatagatgctggacgcatatacatctaggacagtcagatatgtaaatcgtttaaagctttgtgctagtctaatcttgatctgtggttccttttagtcatgatgtttatgccgatacaattatatataaagcagtttttggttaataaacagtaaacttcctgaattaataattaaagtttattttgtattattcaggatggcctcctgatttgataatggaagtcattttgtattattcagtatagccttggtacctggtagatagccatgcttattatgcatattgttttgcagatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatacgacctgcaagcg

SEQ ID NO: 472 - DNA, 415 bp, Zea mays
ataagggtatccctgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggcaggtgcccgctttgccaagtggcgcgctgttctcaagattggccctaatgagccatcacagctgcccaatcgacc

SEQ ID NO: 473 - DNA, 1332 bp, Zea mays
gggctcgtcgcgtcgagcatcgatcatgtcggcctactgcggaaagtacaagggtacgtcccatcgtctcctcctccccccctgtcgtgatcgtatcctcgttcgttgctgatcttcgttgctgatctgcttgtgatgcctttaggtctcgtgtatcgtagatctgtttagttgtttcgttgttggtgcgctcagatctcgctgtgattgatgggtatgctcaggctaacggctatatggacgggagaacactctttgtagactgtactgtccacagatcggagtttgaaatggaatgcgtggtcagaaatctggtggcctagcctaacgattcgtataggtctgagagactcgttcggttgtaggatttgtggattttttttagatccgtacaggattgtgctgtcgtgtgcccgccaggggcttggtggttgccaaaaggtgatgcctctgatcggttaatttggatatgggatttgcttactttttgcttcgattttatacatacatatagtggtatgcatctgctcgtcctgtttccagttgatgaaacatattctcctgctagcaagttttatacaaaaatagagggactagtttttatatggttgtttcaaattatatatagcctgtttgttcaatctaaatatatttgcctgttgtttcatggctactagaatagatgctggacgcatatacatctaggacagtcagatatgtaaatcgtttaaagctttgtgctagtctaatcttgatctgtggttccttttagtcatgatgtttatgccgatacaattatatataaagcagtttttggttaataaacagtaaacttcctgaattaataattaaagtttattttgtattattcaggatggcctcctgatttgataatggaagtcattttgtattattcagtatagccttggtacctggtagatagccatgcttattatgcatattgttttgcagatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgacctggcaagcgcgc

SEQ ID NO: 474 - DNA, 441 bp, Zea mays
ctcattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgctgcgccaagtactacgaggcaggtgcccgctttgccaagtggcgcgctgttctcaagattggcccctaactgagccatcacagcttccatcgacctgccgctcag

SEQ ID NO: 475 - DNA, 1272 bp, Zea mays
gggctcgtcgcgtcgagcatcgatcatgtcggcctactgcggaaagtacaagggtacgtcccatcgtctcctcctccccccctgtcgtgatcgtatcctcgttcgttgctgatcttcgttgctgatctgcttgtgatgcctttaggtctcgtgtatcgtagatctgtttagttgtttcgttgttggtgcgctcagatctcgctgtgattgatgggtatgctaaggctaacggctatatggacgggagaacactctttgtagactgtactgtccacagatcggagtttgaaatggaatgtgtggacagaaatctggtggcctagcctaacgattcgtataggtctgagagactcgttcagttgtaggatttgtggattttttttagatccgtacaggattgtgctgtcgtgtgcccgccaggggcttggtggttgccaaaaggtgatgcctctgatcggttaatttggatatgggatttgcttactttttgcttcgattttatacatacatatagtggtatgcatctgctcgtcctgtttccagttgatgaaacatattctcctgctagcaagttttatacaaaaatagagggactagtttttatatggttgtttcaaattatatatagcctgtttgttcaatctaaatatatttgcctgttgtttcatggctactagaatagatgctggacgcatatacatctaggacagtcagatatgtaaatcgtttaaagctttgtgctagtctaatcttgatctgtggttccttttagtcatgatgtttatgccgatacaattatatataaagcagtttttggttaataaacagtaaacttcctgaattaataattaaagtttattttgtattattcaggatggcctcctgatttgataatggaagtcattttgtattattcagtatagccttggtacctggtagatagccatgcttattatgcatattgttttgcagatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggtgacaagggcaccatgag

SEQ ID NO: 476 - DNA, 936 bp, Zea mays
tcatcacagacactagcaatgttcaaaaccccaactgatccaagctaaaaataaaataaaataaaataaaaataaaggatagcatcccaccaccacgcatgccaacattttatttgatgccccggggcgaaatctccacgaaagctaacttaattaacccaaacaaaccgtctcagcgtagaggcgcagagacggacgctaagactcgatctacctaatgaaccgaaaccgaggacgtcgacgacgaggggcggggcggcgggggacagtgacgtggtggaacggcggggcgtgcggccatctagttggccttggcgatgaggtcctgggcggtggcgaccgtgggcagcgccgggatggcgcccttcttggtggtgcagatggcgccgcaggcgttggagaacttgagagcctcgcggagcttctcctcgttctgagaggggaattaaaaaaaagaagaagcattagcacgtgattgaccatcatcagcaggcagcagcagcagaagagaatgaagcgttccatacgtggaagatggagtcgtccttggcgacgttgacgaggagggagccgacgaaggcgtcgccggcgccggtggtgtcgacggtgtcgaccttgaagccgggcacgctgcccttgaaatccttggtgaagaacctggatacaccaccaacaccacccgcccaatccccttaactataattctccccaatcaccttcatatttccacatctttcccctcaaccataaatccgcccccccgataacacttcaactttcacccaaccccccccattcacactaacaccacactccatcacaactttatacccaacacccccacctcaaaccaacccctcgaactcattcccacaccacacaccccccctaaaactaaccacacataaaaaatatccccccccctactccccaccc

SEQ ID NO: 477 - DNA, 390 bp, Zea mays
tgtgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggcaggtgcccgctttgccaagtggcgcgctgttctcaagattggccctaatgaccatcaccaagcttgc

SEQ ID NO: 478 - DNA, 1104 bp, Zea mays
ctcagctccgaacacatttctgtaatagactagaagggataaactggcatcccagcacaaacttgacgagctgagccgctgccgttgcccaaactcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgctgtattacaagtttatgtcaaatggttaatacatacacaagcgttgttgtattacaagtttatgtcaaatggttaaatacaggaaaatctgtagcattgaaagtgacttacatgctccccaagtcagaccctccatctggacactgcggacagcctcctccagcttcttcatatcagtctcatcgtcccatggtttgacatccataaggacggaggatttaccacctgtaaatatatgcaaagccattaataactatcaagtcctaaaagtcaagtttctgcaagaaaaagtgattataagaaacactaacaagacctaaacaggttctacataaaatccaaatgattataagagacaatgtaggttaacactcctaaatgaaaattatgcatactttctttctttttagaagaggccttggcagcggcggcacgctcatcagctgccttcttgtcctcctcagtttcatcaccaaaaagatcaaggtcatcatcgtcctcagcctgtcgagaattaaaagcagaagacagtgacaacaaaaaagaagcattgatataaagcatacttggcatgcaattaatcacacaacgacaaataggttgatatttaatggaataaaaaataagcatagatcaactggaatttcttccccattgtttgaccaatcaatgaaaaattgtaccatgctaaatcaaacagaacagcactggcccattgtttgaccaataagacagattaattaacaaataaaaaagagatgtggcagtatggcttgggatggggagaacaaacctcatccgcaggagcagctgccgcaggagctatcccgc

SEQ ID NO: 479 - DNA, 371 bp, Zea mays
ttgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggcaggtgcccgctttgccaagtggcgcgctgttctcaagattggccctaat

SEQ ID NO: 480 - DNA, 1373 bp, Zea mays
ctcttagggccatcttgagacagcgcgccacttggcaaagcgggcacctgcctcgtagtacttggcgcaacgcttgccaaggtcgtcatggccttgggtggtggtctccttatcagtgccaacaacctcaatggtgcccttgtcaaccttgatgccagggaggacgcctccctccttgaggacatcaacaaaaggcttgccatccttggtcttctggtacagggtctcctcgaagaggatcacaccgctgatgtactggagagcaccagggcagcagaataggagctcacggagggcacggcggttctcctcaacgttctcgacattgatgctggaaaggcgcttgccaatggtgccagtggactcatcagcagcaaggatacccttgccgggggtgccaatgtaggcagcattcttgatgagctcatctgcaaaacaatatgcataataagcatggctatctaccaggtaccaaggctatactgaataatacaaaatgacttccattatcaaatcaggaggccatcctgaataatacaaaataaactttaattattaattcaggaagtttactgtttattaaccaaaaactgctttatatataattgtatcggcataaacatcatgactaaaaggaaccacagatcaagattagactagcacaaagctttaaacgatttacatatctgactgtcctagatgtatatgcgtccagcatctattctagtagccatgaaacaacaggcaaatatatttagattgaacaaacaggctatatataatttgaaacaaccatataaaaactagtccctctatttttgtataaaacttgctagcaggagaatatgtttcatcaactggaaacaggacgagcagatgcataccactatatgtatgtataaaatcgaagcaaaaagtaagcaaatcccatatccaaattaaccgatcagaggcatcaccttttggcaaccaccaagcccctggcgggcacacgacagcacaatcctgtacggatctaaaaaaaatccacaaatcctacaactgaacgagtctctcagacctatacgaatcgttaggctaggccaccagatttctgtccacacattccatttcaaactccgatctgtggacagtacagtctacaaagagtgttctcccgtccatatagccgttagccttagcatacccatcaatcacagcgagatctgagcgcaccaacaacgaaacaactaaacagatctacgatacacgagacctaaaggcatcacaagcagatcagcaacgaagatcagcaacgaacgaggatacgatcacgacagggggggaggaggagacgatgggacgtaccctgtacttccgcagtggccgacaga

SEQ ID NO: 481 - DNA, 1341 bp, Zea mays
gcgtggcccttgtgactacggaaagactacggccgcctcgtcgtcatcgtcgatgtggtcgaccagaacagggtatgtactgagctctctcataaatgcgtgtcgttctgttcgctgttgtgatttcgatctagagctttagaggaatgcttttgatatagtgtttggttccggagtatggtgggacggctcctaatttgttgttgtttggattggttccatgtagtacagagtggttccaaaaaaggaaaattatgctcaaatgtcgaaccatcccgctctctcggacggagccgctccctggaatgtagcctttctatcccaattggctccggaaccaaacactagtgttagttggttggtatccgctgctcttcgtgagaattatgaaaacgttatatgcctgtatttggcatcgcctgatgcaatttatttgaattggcaaagtagcgtggcgttgtccgcatctagcgtttattaatacctactcttaagatcaatggatgactataagtgccctagcatttggcagtgccaggaggataagggttgcttgccaaacttgttcccttaatgaaccaatgactaattctcttgtttagattccttttaaggcacaatgaatgttcgatatttaacaatatatatttgtggagcctgtgcctcagtaattgatttggttaggcattcaagcactcatggccttgatgcattctatggaccaggcacttgtggacgcccctgatatggtcaggtgccagattaacttcaaacggctctcacttactgacatcaagattgacatcaaacgcgttcccaagaagtcaaccctgatcaaggctatggaggaagctggtaatgatgaacctcatatagtggacctcttcagcaaagttgtgctttattcatctatattctagatgaagataatagtgacaattaattgatgctttgttattcttttttagatgtgaagacgaagtgggaaaacagctcatggggcaagaagctgattgtccagaagaggagggctgcgctcagtgactttgacaggttcaaggtcatgctggcaaggatcaaggtcaggaacctccctgtcaaatgtctagttcctgttggcactgagtatattgtttgctcacacctttttcctttatgtaaacagaggggtggtgctatcaggcaagagctcgccaagctgaagaaggcgtccacggcttaagtcccttttggtggatggcatgttagtttttggtttcatgtttcatcagcattttgttttgagtgttgtcaaagccagaattagtaatagtttcatgtgtccctttcaacttcacaaga

SEQ ID NO: 482 - DNA, 607 bp, Zea mays
ataatcgccaaatgtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgtcttcgatgataatgccttcgatgatgacgccgagtatgatgccgaccatgatgtcaccaatgatgatgacgagtatgataccaccgatgatgatgccgagcatggtgtcaccaatgatgatgccaaacatgatgacagtgccacaatgttactctgattccatctcgcacattatacaacaacaacaattaccattcatgttcagccccacagccatggcgatctcacccatgttcttacagcagccctttgttgggg

SEQ ID NO: 483 - DNA, 496 bp, Zea mays
ggtgtctttcttgtgtaatgtaagcttgctaaatggcaaagattgactaacaagagatgatggaccaacaagggaatgggatcgtttgacaatgacatcagggtcattgtaaacctcatcgttggactcagccacaggtgctggactgcccagagtgagaacactcacttctgtgtgtgtatggacagcactaggcccaaaaacatcagaaaaatcgaactcaacattttcagaaggcacaacatctgaggatccccctggcagaaggatcttccctctaaaaagcttggagccctgtgcacgcgtcactgtgacagaggtcatctcagaggaaaccatcttcgagaacctatgagattccgcaagatgactaggaagtcttgggccacaatttaaggaaggctccttccacacattcccaagacaacggaagatgcagggctgcgaacaatggccttgaacaagtggaaattgacgaaaacaattgaaccccccc

SEQ ID NO: 484 - DNA, 1027 bp, Zea mays
aaaccttgcctgcaaagatttgtatgatatgcgacgttaataggttgaaggcacttgcttcaccaatgtaaggaattttgcacaaaataataatatcacgtggggagaatccaggtaatttacaagatgaaaaaggtactaattttcgaagcatttgttgaatgtttgcaacatgaaggtggcagaaagcaaatgcaacataaagcgtgtaaaattcacaaacctgcgagccatgttggtcgcagaccactagtcttggaactggaaatcgaccctttattatcatctgtgcctcctcatgtggtgcttgtaatagttgtgcaaattgctaaaaaagtgaacagaaagcatcagaatgtgagaacacttaaattgtgtgcacatcagccctgaaaaagaatgaaaaacaatacatgcaaccacaatgtgttctcataaatgacagcacgtaaggccattagtgtgaaaccagcacgacagtggcttccaacttctagcaaaaatgcactccataaaaaagaacatagctctcagcatcaaaacatgggctcaggctagtaataaaggaacatgggctcaggccagtaataaagagaaggaattgttgtggattattctagttacctcatgctcaggttggttctgataacccatgtttctccactgagcaattgtcattccatgaaaaatgacaacactaaagtacgcatcaagtagcagtatacgatctgctgctattgatgccacatctagaaataccggagatggaggtgaatcaaaagaaaatgatatcaaggaaggctggatcatggcaaccgagttagtgatactctcacgattgagtaacatcctgaaataagctgtctcatctggactgttattgaaaacctgtaacataaaatctgatagtattagtggggcaaaaacatttttcagtacatagggtgaaaatgcatgccagctcacctgaacaaattgtgaacgccgaagattaaacataatctgacggaacaatgagaaattgaag

SEQ ID NO: 485 - DNA, 24 bp, Zea mays
agactgcagtgcattccttatgtg

SEQ ID NO: 486 - DNA, 17 bp, Zea mays
tctccaacgcgcagagc

SEQ ID NO: 487 - DNA, 16 bp, Zea mays
cagtggtgtagtaggc

SEQ ID NO: 488 - DNA, 16 bp, Zea mays
agtggtgtagtaagca

SEQ ID NO: 489 - DNA, 27 bp, Zea mays
tcttgacatcacacctacagaggtatc

SEQ ID NO: 490 - DNA, 24 bp, Zea mays
cgacgcaaactggttaatctatca

SEQ ID NO: 491 - DNA, 17 bp, Zea mays
tctacactcaagatcaa

SEQ ID NO: 492 - DNA, 17 bp, Zea mays
acagttctacattcaag

SEQ ID NO: 493 - DNA, 23 bp, Zea mays
tagcagggtatgttacgcagtga

SEQ ID NO: 494 - DNA, 24 bp, Zea mays
catatgcgctactgttccacacta

SEQ ID NO: 495 - DNA, 15 bp, Zea mays
tgggagggttctaat

SEQ ID NO: 496 - DNA, 16 bp, Zea mays
tgggaggattctaatg

SEQ ID NO: 497 - DNA, 20 bp, Zea mays
cagtagccgcagcacaaaca

SEQ ID NO: 498 - DNA, 25 bp, Zea mays
cagagctgctgcaagtaatgttatc

SEQ ID NO: 499 - DNA, 17 bp, Zea mays
aaattgctacagttctt

SEQ ID NO: 500 - DNA, 16 bp, Zea mays
tgctacagtgcttatt

SEQ ID NO: 501 - DNA, 25 bp, Zea mays
gcggaccataaatcttcttcataaa

SEQ ID NO: 502 - DNA, 27 bp, Zea mays
tttttttcttattttggtggaatgact

SEQ ID NO: 503 - DNA, 14 bp, Zea mays
acaggcagaggtac

SEQ ID NO: 504 - DNA, 16 bp, Zea mays
aggcagagttacgacc

SEQ ID NO: 505 - DNA, 21 bp, Zea mays
gccacatgatcgaggatgact

SEQ ID NO: 506 - DNA, 26 bp, Zea mays
actcgattaccttggataggatcttg

SEQ ID NO: 507 - DNA, 15 bp, Zea mays
agggataccgttgtc

SEQ ID NO: 508 - DNA, 16 bp, Zea mays
agagggatgccgttgt

SEQ ID NO: 509 - DNA, 25 bp, Zea mays
gctctaaatggtttgctgctgtaag

SEQ ID NO: 510 - DNA, 20 bp, Zea mays
tggctctgcacatccaaaaa

SEQ ID NO: 511 - DNA, 16 bp, Zea mays
tgggtactgacaacaa

SEQ ID NO: 512 - DNA, 17 bp, Zea mays
tgggtactaacaacaag

SEQ ID NO: 513 - DNA, 21 bp, Zea mays
gcccctgtaaagatggttgga

SEQ ID NO: 514 - DNA, 19 bp, Zea mays
ttctcccggcaccataagc

SEQ ID NO: 515 - DNA, 16 bp, Zea mays
tgcatagctgatgaat

SEQ ID NO: 516 - DNA, 15 bp, Zea mays
ccctgcatagttgat

SEQ ID NO: 517 - DNA, 22 bp, Zea mays
gcagcagcaacaacaacagtct

SEQ ID NO: 518 - DNA, 28 bp, Zea mays
ccgtaaattatggttaggtttcaattct

SEQ ID NO: 519 - DNA, 17 bp, Zea mays
cctactccaacttattt

SEQ ID NO: 520 - DNA, 17 bp, Zea mays
cctactccaacttgttt

SEQ ID NO: 521 - DNA, 23 bp, Zea mays
tgtgtgtccgaaactagctagca

SEQ ID NO: 522 - DNA, 25 bp, Zea mays
cttccaagttccaagtcatctacgt

SEQ ID NO: 523 - DNA, 15 bp, Zea mays
acagcctctttgggt

SEQ ID NO: 524 - DNA, 15 bp, Zea mays
cacagctctttgggt

SEQ ID NO: 525 - DNA, 23 bp, Zea mays
cagacacatgtgatgccagagtt

SEQ ID NO: 526 - DNA, 18 bp, Zea mays
gggggcgaatgaaaaatg

SEQ ID NO: 527 - DNA, 16 bp, Zea mays
tgcaactctaatgtct

SEQ ID NO: 528 - DNA, 15 bp, Zea mays
caactcgaatgtctc

SEQ ID NO: 529 - DNA, 24 bp, Zea mays
ggagtcgtctggtataccgtccta

SEQ ID NO: 530 - DNA, 22 bp, Zea mays
cttcggatcgctacaaggtgat

SEQ ID NO: 531 - DNA, 14 bp, Zea mays
cgaagcgaccttac

SEQ ID NO: 532 - DNA, 14 bp, Zea mays
cgaagcaaccttac

SEQ ID NO: 533 - DNA, 25 bp, Zea mays
tgcggtacttgtacaatctatggaa

SEQ ID NO: 534 - DNA, 28 bp, Zea mays
gatagtgtgaccatctgagaagctttaa

SEQ ID NO: 535 - DNA, 15 bp, Zea mays
aacccgcttacaagc

SEQ ID NO: 536 - DNA, 15 bp, Zea mays
aacccccttacaagc

SEQ ID NO: 537 - DNA, 25 bp, Zea mays
gctgatccaggggttagtcagttat

SEQ ID NO: 538 - DNA, 28 bp, Zea mays
attctccaaaaaagttggaatgacttat

SEQ ID NO: 539 - DNA, 16 bp, Zea mays
cagtcatgattatttc

SEQ ID NO: 540 - DNA, 20 bp, Zea mays
cagtcatttatttcgattgt

SEQ ID NO: 541 - DNA, 24 bp, Zea mays
caggttggctagtgttctcattgt

SEQ ID NO: 542 - DNA, 21 bp, Zea mays
tgtagaccctcagcgatttgg

SEQ ID NO: 543 - DNA, 16 bp, Zea mays
agctgatgacactatg

SEQ ID NO: 544 - DNA, 16 bp, Zea mays
ctgatggcactatgat

SEQ ID NO: 545 - DNA, 25 bp, Zea mays
tgtagttcctagatcacagcatgca

SEQ ID NO: 546 - DNA, 21 bp, Zea mays
tcgaggtccaacaatcaccaa

SEQ ID NO: 547 - DNA, 14 bp, Zea mays
actgggtggaaatg

SEQ ID NO: 548 - DNA, 15 bp, Zea mays
tactggctggaaatg

SEQ ID NO: 549 - DNA, 25 bp, Zea mays
aaacaaaagaacagctggtaaaacg

SEQ ID NO: 550 - DNA, 25 bp, Zea mays
tgaccacccttacacagtactcgta

SEQ ID NO: 551 - DNA, 16 bp, Zea mays
cttcagatgaactatc

SEQ ID NO: 552 - DNA, 15 bp, Zea mays
ttcaggtgaactatc

SEQ ID NO: 553 - DNA, 25 bp, Zea mays
tgtacattgtcgttcacatcttgct

SEQ ID NO: 554 - DNA, 23 bp, Zea mays
ccactgttctccagtcctcttca

SEQ ID NO: 555 - DNA, 15 bp, Zea mays
cttcgataaaatggc

SEQ ID NO: 556 - DNA, 14 bp, Zea mays
cttcgacaaaatgg

SEQ ID NO: 557 - DNA, 23 bp, Zea mays
atcaagccaaggaatctgtcatg

SEQ ID NO: 558 - DNA, 24 bp, Zea mays
aaagactaaacattgcaggaggct

SEQ ID NO: 559 - DNA, 15 bp, Zea mays
catgggcatgtgaag

SEQ ID NO: 560 - DNA, 15 bp, Zea mays
catggccatgtgaag

SEQ ID NO: 561 - DNA, 23 bp, Zea mays
cctgcaaaaggcaagacattaga

SEQ ID NO: 562 - DNA, 23 bp, Zea mays
tcttccccatgtgctattcattg

SEQ ID NO: 563 - DNA, 15 bp, Zea mays
aaacgatggcaaaat

SEQ ID NO: 564 - DNA, 13 bp, Zea mays
cgatggaaaaatt

SEQ ID NO: 565 - DNA, 19 bp, Zea mays
tgagcgtgtagcgcatgtg

SEQ ID NO: 566 - DNA, 17 bp, Zea mays
cagctgagcgcgatgca

SEQ ID NO: 567 - DNA, 13 bp, Zea mays
cggcttgagcagc

SEQ ID NO: 568 - DNA, 13 bp, Zea mays
cggcttcagcagc

SEQ ID NO: 569 - DNA, 16 bp, Zea mays
ggcggcaccagaacca

SEQ ID NO: 570 - DNA, 18 bp, Zea mays
gatccgaatgccgatgct

SEQ ID NO: 571 - DNA, 14 bp, Zea mays
aaggcaagctacgc

SEQ ID NO: 572 - DNA, 14 bp, Zea mays
tcaaggccagctac

SEQ ID NO: 573 - DNA, 26 bp, Zea mays
gaggctggttatatttgcaggttatt

SEQ ID NO: 574 - DNA, 26 bp, Zea mays
cccaagttttatagcatgttttttca

SEQ ID NO: 575 - DNA, 16 bp, Zea mays
ctgaaacttcaaattt

SEQ ID NO: 576 - DNA, 17 bp, Zea mays
ctgaaactttaaatttg

SEQ ID NO: 577 - DNA, 19 bp, Zea mays
gacctgcagagccgtgaag

SEQ ID NO: 578 - DNA, 20 bp, Zea mays
gccatctcggccatgtttta

SEQ ID NO: 579 - DNA, 15 bp, Zea mays
cgtaccaaactgtcc

SEQ ID NO: 580 - DNA, 15 bp, Zea mays
cgtaccaaacagtcc

SEQ ID NO: 581 - DNA, 20 bp, Zea mays
tgtccggcaacatgctctct

SEQ ID NO: 582 - DNA, 19 bp, Zea mays
tgccggtgagttggttgtc

SEQ ID NO: 583 - DNA, 17 bp, Zea mays
ccaagaaaataagctgc

SEQ ID NO: 584 - DNA, 16 bp, Zea mays
caagaaagtaagctgc

SEQ ID NO: 585 - DNA, 19 bp, Zea mays
acttgcgtcttgcgatcga

SEQ ID NO: 586 - DNA, 15 bp, Zea mays
cgcggctgcctctcc

SEQ ID NO: 587 - DNA, 13 bp, Zea mays
tggtgggttcctc

SEQ ID NO: 588 - DNA, 14 bp, Zea mays
tttggtgggtcctc

SEQ ID NO: 589 - DNA, 29 bp, Zea mays
cttggttcatttcttgacctttaaaatat

SEQ ID NO: 590 - DNA, 29 bp, Zea mays
caaatttgtcactgataattattgggata

SEQ ID NO: 591 - DNA, 19 bp, Zea mays
acatacagtgttaaatata

SEQ ID NO: 592 - DNA, 20 bp, Zea mays
acatacattgttaaatatag

SEQ ID NO: 593 - DNA, 26 bp, Zea mays
tagtgccaattacagggtatgtgttt

SEQ ID NO: 594 - DNA, 21 bp, Zea mays
ccattcaaaagggcaatcaca

SEQ ID NO: 595 - DNA, 16 bp, Zea mays
agcaatttcaaaaaga

SEQ ID NO: 596 - DNA, 16 bp, Zea mays
agcaatttcaaaagga

SEQ ID NO: 597 - DNA, 19 bp, Zea mays
catggcagcaccagcactc

SEQ ID NO: 598 - DNA, 21 bp, Zea mays
cactggctgtgctcacaactg

SEQ ID NO: 599 - DNA, 14 bp, Zea mays
accacatgaatggg

SEQ ID NO: 600 - DNA, 14 bp, Zea mays
caccacgtgaatgg

SEQ ID NO: 601 - DNA, 23 bp, Zea mays
gaccttgctgaatatgtgctgaa

SEQ ID NO: 602 - DNA, 24 bp, Zea mays
catgacatagttcccagaattcca

SEQ ID NO: 603 - DNA, 15 bp, Zea mays
agctcatccgactgg

SEQ ID NO: 604 - DNA, 15 bp, Zea mays
cagctcacccgactg

SEQ ID NO: 605 - DNA, 25 bp, Zea mays
gagtaatccatatgaaggtgttgca

SEQ ID NO: 606 - DNA, 24 bp, Zea mays
gccaaagctagtaatgggttcatc

SEQ ID NO: 607 - DNA, 15 bp, Zea mays
ttgcctttcatattc

SEQ ID NO: 608 - DNA, 15 bp, Zea mays
ttgcctttcatgttc

SEQ ID NO: 609 - DNA, 25 bp, Zea mays
tgcatctaggggagtgtataatcga

SEQ ID NO: 610 - DNA, 18 bp, Zea mays
gcgcccatgagcaatgac

SEQ ID NO: 611 - DNA, 15 bp, Zea mays
cacacacctagatgc

SEQ ID NO: 612 - DNA, 14 bp, Zea mays
cacacgcctagatg

SEQ ID NO: 613 - DNA, 16 bp, Zea mays
gcgccgaggtgatgga

SEQ ID NO: 614 - DNA, 18 bp, Zea mays
gcgtcctctccgcttgct

SEQ ID NO: 615 - DNA, 14 bp, Zea mays
tcgtcaacgagggc

SEQ ID NO: 616 - DNA, 13 bp, Zea mays
cgggctcgtcgac

SEQ ID NO: 617 - DNA, 21 bp, Zea mays
tgcgtgacattgctcttctga

SEQ ID NO: 618 - DNA, 24 bp, Zea mays
gcaagagaacacacaaggagaaaa

SEQ ID NO: 619 - DNA, 15 bp, Zea mays
acacacgttggctgt

SEQ ID NO: 620 - DNA, 15 bp, Zea mays
cacacattggctgtc

SEQ ID NO: 621 - DNA, 18 bp, Zea mays
cgccatgagccacacgta

SEQ ID NO: 622 - DNA, 19 bp, Zea mays
cgctgctgctgaacctgat

SEQ ID NO: 623 - DNA, 15 bp, Zea mays
ccgactgttcgaatg

SEQ ID NO: 624 - DNA, 14 bp, Zea mays
cgactgctcgaatg

SEQ ID NO: 625 - DNA, 28 bp, Zea mays
attagcaaatgtttattgtagcatcaca

SEQ ID NO: 626 - DNA, 29 bp, Zea mays
gataaggactaaacggtaagatgagtcaa

SEQ ID NO: 627 - DNA, 19 bp, Zea mays
ctgattagactattattcg

SEQ ID NO: 628 - DNA, 18 bp, Zea mays
taggcctgattagtctat

SEQ ID NO: 629 - DNA, 23 bp, Zea mays
cttcaaaaaggaacttgcgtgat

SEQ ID NO: 630 - DNA, 22 bp, Zea mays
ggttgagggagggagtacaaca

SEQ ID NO: 631 - DNA, 18 bp, Zea mays
agtgatgtacaccagaat

SEQ ID NO: 632 - DNA, 15 bp, Zea mays
tgtacatcagaatcc

SEQ ID NO: 633 - DNA, 23 bp, Zea mays
gcaacaaattagcagaggcaatg

SEQ ID NO: 634 - DNA, 27 bp, Zea mays
agatgaggtttgtaaatgtggaacttt

SEQ ID NO: 635 - DNA, 15 bp, Zea mays
agctaccgagcaata

SEQ ID NO: 636 - DNA, 15 bp, Zea mays
ctaccaagcaatatt

SEQ ID NO: 637 - DNA, 22 bp, Zea mays
aagggcctcactttcgtagttg

SEQ ID NO: 638 - DNA, 22 bp, Zea mays
tgttctggagggagtgtcatca

SEQ ID NO: 639 - DNA, 16 bp, Zea mays
tgttcccgatggtgag

SEQ ID NO: 640 - DNA, 14 bp, Zea mays
tgttcccaatggtg

SEQ ID NO: 641 - DNA, 23 bp, Zea mays
ccacacacacctgctcttcacta

SEQ ID NO: 642 - DNA, 23 bp, Zea mays
gctggttgttgtgatcagattcc

SEQ ID NO: 643 - DNA, 15 bp, Zea mays
ccctttgcctaaaaa

SEQ ID NO: 644 - DNA, 18 bp, Zea mays
agaaccctttacctaaaa

SEQ ID NO: 645 - DNA, 28 bp, Zea mays
tcacagaaaatgttctaaatagcatggt

SEQ ID NO: 646 - DNA, 25 bp, Zea mays
cgatgcactcctatatccagatttg

SEQ ID NO: 647 - DNA, 14 bp, Zea mays
aatgggccaagtta

SEQ ID NO: 648 - DNA, 16 bp, Zea mays
agaatggaccaagtta

SEQ ID NO: 649 - DNA, 25 bp, Zea mays
caaacaggataaacaagagcattca

SEQ ID NO: 650 - DNA, 25 bp, Zea mays
tctgtggctttattcatcctcattt

SEQ ID NO: 651 - DNA, 17 bp, Zea mays
atttggtttcaatattg

SEQ ID NO: 652 - DNA, 16 bp, Zea mays
tggtttcgatattgac

SEQ ID NO: 653 - DNA, 23 bp, Zea mays
caaacgacaatgtccaaactcaa

SEQ ID NO: 654 - DNA, 23 bp, Zea mays
attttttgtgtcagggcaatgag

SEQ ID NO: 655 - DNA, 15 bp, Zea mays
tgaacgaccactaaa

SEQ ID NO: 656 - DNA, 16 bp, Zea mays
catcatgaacaaccac

SEQ ID NO: 657 - DNA, 25 bp, Zea mays
gtggtggtgaaaataagagttgctt

SEQ ID NO: 658 - DNA, 25 bp, Zea mays
agcacttgttgacatgcatagttct

SEQ ID NO: 659 - DNA, 16 bp, Zea mays
cacaacttccatgaat

SEQ ID NO: 660 - DNA, 18 bp, Zea mays
cacaactttcatgaatat

SEQ ID NO: 661 - DNA, 24 bp, Zea mays
cactatatcagctccggtcctaca

SEQ ID NO: 662 - DNA, 23 bp, Zea mays
ggtatttttcaggtgccaaaggt

SEQ ID NO: 663 - DNA, 14 bp, Zea mays
cgccgtgatgacaa

SEQ ID NO: 664 - DNA, 14 bp, Zea mays
cgccgtgatgataa

SEQ ID NO: 665 - DNA, 24 bp, Zea mays
gcctctgatctgatatcggaactc

SEQ ID NO: 666 - DNA, 29 bp, Zea mays
aaacaaattagattttgaccattaattcc

SEQ ID NO: 667 - DNA, 15 bp, Zea mays
ttagcgaacgaaaac

SEQ ID NO: 668 - DNA, 17 bp, Zea mays
tttagcaaacgaaaaca

SEQ ID NO: 669 - DNA, 28 bp, Zea mays
gtagacttcataaatcaggaacccagat

SEQ ID NO: 670 - DNA, 28 bp, Zea mays
cagggtttctgatccatatagtctgtac

SEQ ID NO: 671 - DNA, 19 bp, Zea mays
tgggaaaaagttttaaaat

SEQ ID NO: 672 - DNA, 19 bp, Zea mays
atgggaaaaagtttaaaaa

SEQ ID NO: 673 - DNA, 23 bp, Zea mays
taacacaaagaagcatccgtcct

SEQ ID NO: 674 - DNA, 25 bp, Zea mays
tgaatttgtcatttctcatgctgat

SEQ ID NO: 675 - DNA, 16 bp, Zea mays
atcatgtagcaatacc

SEQ ID NO: 676 - DNA, 15 bp, Zea mays
tcatgaagcaatacc

SEQ ID NO: 677 - DNA, 21 bp, Zea mays
cccagagaatggctcctatgc

SEQ ID NO: 678 - DNA, 28 bp, Zea mays
gactggatgaacatttataagaaaacca

SEQ ID NO: 679 - DNA, 15 bp, Zea mays
caatcagattcctcg

SEQ ID NO: 680 - DNA, 16 bp, Zea mays
acaatcaaattcctcg

SEQ ID NO: 681 - DNA, 21 bp, Zea mays
cggcaaccttacgtcgataga

SEQ ID NO: 682 - DNA, 26 bp, Zea mays
ggaacaagctagatggtactgttgaa

SEQ ID NO: 683 - DNA, 17 bp, Zea mays
ctacttgtctgataatc

SEQ ID NO: 684 - DNA, 14 bp, Zea mays
cttgtccgataatc

SEQ ID NO: 685 - DNA, 28 bp, Zea mays
aacctttctttctttaaccatcaatttc

SEQ ID NO: 686 - DNA, 29 bp, Zea mays
gcttaacaacatgcaaattatatgctatg

SEQ ID NO: 687 - DNA, 18 bp, Zea mays
atcgtatgatttaagttc

SEQ ID NO: 688 - DNA, 18 bp, Zea mays
attatcgtacgatttaag

SEQ ID NO: 689 - DNA, 28 bp, Zea mays
caaattgttggtcaaagtttgtaaaatt

SEQ ID NO: 690 - DNA, 19 bp, Zea mays
aaggaactgccccctccat

SEQ ID NO: 691 - DNA, 18 bp, Zea mays
aagcgtattttgaacaag

SEQ ID NO: 692 - DNA, 16 bp, Zea mays
tgataagcgttttttg

SEQ ID NO: 693 - DNA, 19 bp, Zea mays
cgaagaaaatccgcaacga

SEQ ID NO: 694 - DNA, 20 bp, Zea mays
agggcagcgacagaagaatc

SEQ ID NO: 695 - DNA, 15 bp, Zea mays
cgatatcgcggtgct

SEQ ID NO: 696 - DNA, 16 bp, Zea mays
acgatattgcggtgct

SEQ ID NO: 697 - DNA, 22 bp, Zea mays
ccactaccaccaccgtctcagt

SEQ ID NO: 698 - DNA, 20 bp, Zea mays
gagcccacccattcagaaca

SEQ ID NO: 699 - DNA, 13 bp, Zea mays
tgctgcggtttgt

SEQ ID NO: 700 - DNA, 15 bp, Zea mays
ctgcgttttgttttt

SEQ ID NO: 701 - DNA, 23 bp, Zea mays
attctcagacgtgctaccgacat

SEQ ID NO: 702 - DNA, 20 bp, Zea mays
cgatgtctattgcggttcca

SEQ ID NO: 703 - DNA, 15 bp, Zea mays
ccatctacaaacctt

SEQ ID NO: 704 - DNA, 16 bp, Zea mays
tccatctacaagcctt

SEQ ID NO: 705 - DNA, 20 bp, Zea mays
agctgttgcaaaccgtgtga

SEQ ID NO: 706 - DNA, 18 bp, Zea mays
tggagccacctgcaagga

SEQ ID NO: 707 - DNA, 15 bp, Zea mays
tcttgcttgccctca

SEQ ID NO: 708 - DNA, 14 bp, Zea mays
cctcttgtttgccc

SEQ ID NO: 709 - DNA, 24 bp, Zea mays
cttgaggagccctgtattggtatt

SEQ ID NO: 710 - DNA, 26 bp, Zea mays
tgcattctgtacctgtgtagtgatca

SEQ ID NO: 711 - DNA, 17 bp, Zea mays
agtgcagtaagttttat

SEQ ID NO: 712 - DNA, 15 bp, Zea mays
tgcagcaagttttat

SEQ ID NO: 713 - DNA, 24 bp, Zea mays
ggattcgttccagcttatcaaaac

SEQ ID NO: 714 - DNA, 20 bp, Zea mays
cacggattggaggcctgtaa

SEQ ID NO: 715 - DNA, 14 bp, Zea mays
cggattgcttctct

SEQ ID NO: 716 - DNA, 16 bp, Zea mays
ctagtcggattgtttc

SEQ ID NO: 717 - DNA, 21 bp, Zea mays
tgatgttttgctcaggttgca

SEQ ID NO: 718 - DNA, 20 bp, Zea mays
cacacgttcccagcatgatc

SEQ ID NO: 719 - DNA, 16 bp, Zea mays
tggagaacggatacac

SEQ ID NO: 720 - DNA, 16 bp, Zea mays
tggagaacagatacac

SEQ ID NO: 721 - DNA, 20 bp, Zea mays
agcaaggatgtccgcttcag

SEQ ID NO: 722 - DNA, 26 bp, Zea mays
ctgttcgttgtttttaattcgtatcg

SEQ ID NO: 723 - DNA, 15 bp, Zea mays
acagtccgatttaat

SEQ ID NO: 724 - DNA, 15 bp, Zea mays
acagtcggatttaat

SEQ ID NO: 725 - DNA, 22 bp, Zea mays
gcagtttctccgctacaattgg

SEQ ID NO: 726 - DNA, 23 bp, Zea mays
cggcttcttctgacatacaaacc

SEQ ID NO: 727 - DNA, 17 bp, Zea mays
aacggtatcatgaactt

SEQ ID NO: 728 - DNA, 15 bp, Zea mays
cggtatcacgaactt

SEQ ID NO: 729 - DNA, 23 bp, Zea mays
catatcccaatcgctcagctaaa

SEQ ID NO: 730 - DNA, 22 bp, Zea mays
tgcagggattggtttttctttt

SEQ ID NO: 731 - DNA, 15 bp, Zea mays
tgctaggaataatgc

SEQ ID NO: 732 - DNA, 15 bp, Zea mays
tgctaggaattatgc

SEQ ID NO: 733 - DNA, 21 bp, Zea mays
gttcccagcagcaaaaacaaa

SEQ ID NO: 734 - DNA, 20 bp, Zea mays
cactggtggcctagcgtcta

SEQ ID NO: 735 - DNA, 16 bp, Zea mays
aagcacgtttaggcac

SEQ ID NO: 736 - DNA, 16 bp, Zea mays
agcacgtttagacact

SEQ ID NO: 737 - DNA, 25 bp, Zea mays
ccagcattaccttccactaaaagaa

SEQ ID NO: 738 - DNA, 24 bp, Zea mays
atggagattgtttgttttgaccaa

SEQ ID NO: 739 - DNA, 16 bp, Zea mays
aagacacttaaatggc

SEQ ID NO: 740 - DNA, 16 bp, Zea mays
aaagacacctaaatgg

SEQ ID NO: 741 - DNA, 22 bp, Zea mays
caggagcagccctaggatctac

SEQ ID NO: 742 - DNA, 17 bp, Zea mays
cacggccgcctgagact

SEQ ID NO: 743 - DNA, 14 bp, Zea mays
ttcgcggtgcacca

SEQ ID NO: 744 - DNA, 13 bp, Zea mays
cgcggtccaccac

SEQ ID NO: 745 - DNA, 19 bp, Zea mays
cgtaccatgctcggcaaga

SEQ ID NO: 746 - DNA, 16 bp, Zea mays
ggcagcggtggtccat

SEQ ID NO: 747 - DNA, 15 bp, Zea mays
tggaaccagtaatca

SEQ ID NO: 748 - DNA, 15 bp, Zea mays
tggaaccactaatca

SEQ ID NO: 749 - DNA, 21 bp, Zea mays
gcaaggtaatgctgccacttt

SEQ ID NO: 750 - DNA, 22 bp, Zea mays
aattggccattaagcacaacaa

SEQ ID NO: 751 - DNA, 15 bp, Zea mays
caatgccaacataac

SEQ ID NO: 752 - DNA, 18 bp, Zea mays
acaatgtcaacataacaa

SEQ ID NO: 753 - DNA, 24 bp, Zea mays
caggcttctctagtccgtatttgg

SEQ ID NO: 754 - DNA, 28 bp, Zea mays
tttggtaaaccagtagaccagataaatg

SEQ ID NO: 755 - DNA, 18 bp, Zea mays
tgtactggaacatatact

SEQ ID NO: 756 - DNA, 18 bp, Zea mays
tccaatctgtactagaac

SEQ ID NO: 757 - DNA, 28 bp, Zea mays
tgaagaaggattgagatatgaaaagaca

SEQ ID NO: 758 - DNA, 20 bp, Zea mays
gcataaagcgggaagtggaa

SEQ ID NO: 759 - DNA, 15 bp, Zea mays
ttccacggacgtcgt

SEQ ID NO: 760 - DNA, 15 bp, Zea mays
cggttccacagacgt

SEQ ID NO: 761 - DNA, 24 bp, Zea mays
gccatgcattttgataaacttgtt

SEQ ID NO: 762 - DNA, 23 bp, Zea mays
cctgatcaagatcattcccaaga

SEQ ID NO: 763 - DNA, 15 bp, Zea mays
cgattcggtttcaag

SEQ ID NO: 764 - DNA, 15 bp, Zea mays
agcgattcagtttca

SEQ ID NO: 765 - DNA, 22 bp, Zea mays
cgctcagaaaatacgtgccttt

SEQ ID NO: 766 - DNA, 15 bp, Zea mays
ctggcgcgcctgtca

SEQ ID NO: 767 - DNA, 13 bp, Zea mays
tgcaagcaattca

SEQ ID NO: 768 - DNA, 14 bp, Zea mays
tgcaaacaattcac

SEQ ID NO: 769 - DNA, 21 bp, Zea mays
ggagagaaaccgaggcaagtc

SEQ ID NO: 770 - DNA, 19 bp, Zea mays
gcaccagtcgctgattcga

SEQ ID NO: 771 - DNA, 14 bp, Zea mays
cctctccacaattg

SEQ ID NO: 772 - DNA, 15 bp, Zea mays
ctctccacatttgtg

SEQ ID NO: 773 - DNA, 20 bp, Zea mays
cgagtgagcggaaggatcaa

SEQ ID NO: 774 - DNA, 21 bp, Zea mays
gcgatcagctacaacgtccat

SEQ ID NO: 775 - DNA, 13 bp, Zea mays
agtcgccctgcct

SEQ ID NO: 776 - DNA, 15 bp, Zea mays
agtcgctctgcctgt

SEQ ID NO: 777 - DNA, 26 bp, Zea mays
ctctcaccttttcttttttcttccat

SEQ ID NO: 778 - DNA, 21 bp, Zea mays
atggagatttgcatgccaagt

SEQ ID NO: 779 - DNA, 15 bp, Zea mays
tcaaatacaagcccc

SEQ ID NO: 780 - DNA, 16 bp, Zea mays
caatcaaagacaagcc

SEQ ID NO: 781 - DNA, 27 bp, Zea mays
ctgaggcagcatatataaatttcattg

SEQ ID NO: 782 - DNA, 28 bp, Zea mays
ccaaaacctcctagtacataacaagaaa

SEQ ID NO: 783 - DNA, 17 bp, Zea mays
aggacatcgtataggga

SEQ ID NO: 784 - DNA, 18 bp, Zea mays
aggacatcgtataggtaa

SEQ ID NO: 785 - DNA, 27 bp, Zea mays
gccttcacaggttggtacttaatctct

SEQ ID NO: 786 - DNA, 29 bp, Zea mays
aaaatgactgtcaatatgcatagaaaaaa

SEQ ID NO: 787 - DNA, 15 bp, Zea mays
agacatcatatttcc

SEQ ID NO: 788 - DNA, 17 bp, Zea mays
cctaagacatcatgttt

SEQ ID NO: 789 - DNA, 21 bp, Zea mays
catggagtgctgaagctccag

SEQ ID NO: 790 - DNA, 21 bp, Zea mays
cttgtgtgttcgatgctgcaa

SEQ ID NO: 791 - DNA, 16 bp, Zea mays
tcgtgtatccaggcta

SEQ ID NO: 792 - DNA, 16 bp, Zea mays
cgtgtatccatgctat

SEQ ID NO: 793 - DNA, 17 bp, Zea mays
ggcacgcacgtcatcgt

SEQ ID NO: 794 - DNA, 21 bp, Zea mays
cctgatcttcatcttgccgaa

SEQ ID NO: 795 - DNA, 14 bp, Zea mays
ccaccagccccgtg

SEQ ID NO: 796 - DNA, 14 bp, Zea mays
ccacctgccccgtg

SEQ ID NO: 797 - DNA, 20 bp, Zea mays
ggaagggagatgaccgtgaa

SEQ ID NO: 798 - DNA, 18 bp, Zea mays
acttgggcctcgctgtga

SEQ ID NO: 799 - DNA, 15 bp, Zea mays
tgagtggaggccatt

SEQ ID NO: 800 - DNA, 16 bp, Zea mays
tgagtgaaggccattg

SEQ ID NO: 801 - DNA, 30 bp, Zea mays
cctcaatggataactaaaatgaactaaacc

SEQ ID NO: 802 - DNA, 30 bp, Zea mays
atgaataataaaaggaccaaaatacacctt

SEQ ID NO: 803 - DNA, 18 bp, Zea mays
ataatgatgtgaaaatac

SEQ ID NO: 804 - DNA, 15 bp, Zea mays
aatgacgtgaaaata

SEQ ID NO: 805 - DNA, 21 bp, Zea mays
ggctcctgaaacagacaagca

SEQ ID NO: 806 - DNA, 24 bp, Zea mays
tgcttcttgccattatttcagtgt

SEQ ID NO: 807 - DNA, 13 bp, Zea mays
cacacgtaatctc

SEQ ID NO: 808 - DNA, 16 bp, Zea mays
aacacacttaatctct

SEQ ID NO: 809 - DNA, 21 bp, Zea mays
catggcagcagacagtcaaca

SEQ ID NO: 810 - DNA, 20 bp, Zea mays
cctccttggccaatgaacaa

SEQ ID NO: 811 - DNA, 14 bp, Zea mays
caacgttcgccgct

SEQ ID NO: 812 - DNA, 13 bp, Zea mays
caacgctcgccgc

SEQ ID NO: 813 - DNA, 24 bp, Zea mays
gaccatgaaacaaatctaccgaaa

SEQ ID NO: 814 - DNA, 24 bp, Zea mays
ggttctgggtccaagagtattagg

SEQ ID NO: 815 - DNA, 15 bp, Zea mays
tgcctgtgatataag

SEQ ID NO: 816 - DNA, 16 bp, Zea mays
tgtgcctgtaatataa

SEQ ID NO: 817 - DNA, 20 bp, Zea mays
cccgtccacctggtagttgt

SEQ ID NO: 818 - DNA, 17 bp, Zea mays
tgcaggaagggatcgca

SEQ ID NO: 819 - DNA, 13 bp, Zea mays
tggacgcgaaggt

SEQ ID NO: 820 - DNA, 15 bp, Zea mays
tgatggacgcaaagg

SEQ ID NO: 821 - DNA, 25 bp, Zea mays
gggtacccatttcaaaccaattata

SEQ ID NO: 822 - DNA, 27 bp, Zea mays
gaattttgttcaattaggaaccagatc

SEQ ID NO: 823 - DNA, 17 bp, Zea mays
tctgacatatcatgctc

SEQ ID NO: 824 - DNA, 15 bp, Zea mays
tctgacatcatgctc

SEQ ID NO: 825 - DNA, 24 bp, Zea mays
cagtcagttaggctcagctgtcat

SEQ ID NO: 826 - DNA, 19 bp, Zea mays
cggcggcttcttactgttg

SEQ ID NO: 827 - DNA, 14 bp, Zea mays
aagctcgcacgcaa

SEQ ID NO: 828 - DNA, 15 bp, Zea mays
aagcttgcacgcaat

SEQ ID NO: 829 - DNA, 26 bp, Zea mays
agaatcttgtagaccctgatgtcatg

SEQ ID NO: 830 - DNA, 28 bp, Zea mays
caaacggatatgagttgtaccaactaaa

SEQ ID NO: 831 - DNA, 16 bp, Zea mays
ccatggtactgttgtc

SEQ ID NO: 832 - DNA, 16 bp, Zea mays
ccatggtactgtggtc

SEQ ID NO: 833 - DNA, 25 bp, Zea mays
ggaattgtttcgttctatgccaata

SEQ ID NO: 834 - DNA, 23 bp, Zea mays
gtcaacactcggattggagaaaa

SEQ ID NO: 835 - DNA, 16 bp, Zea mays
acatggcttcgttaga

SEQ ID NO: 836 - DNA, 16 bp, Zea mays
tggcttcggtagacta

SEQ ID NO: 837 - DNA, 20 bp, Zea mays
gggttgggcagaagcattta

SEQ ID NO: 838 - DNA, 26 bp, Zea mays
ccaaggaatccttgcctatatattca

SEQ ID NO: 839 - DNA, 15 bp, Zea mays
ttggcgctctgatac

SEQ ID NO: 840 - DNA, 15 bp, Zea mays
ttggccctctgatac

SEQ ID NO: 841 - DNA, 34 bp, Zea mays
ggagtcttttatttattcagagatagtcctaact

SEQ ID NO: 842 - DNA, 28 bp, Zea mays
cttgctcttcagtttactacttgcaaat

SEQ ID NO: 843 - DNA, 18 bp, Zea mays
caaaaatggatgttgctt

SEQ ID NO: 844 - DNA, 16 bp, Zea mays
caaaaacggatgttgc

SEQ ID NO: 845 - DNA, 21 bp, Zea mays
gggtgaatccgtgataagcaa

SEQ ID NO: 846 - DNA, 20 bp, Zea mays
tggaacgagaaccaaatgca

SEQ ID NO: 847 - DNA, 15 bp, Zea mays
aggcaaggtacgcac

SEQ ID NO: 848 - DNA, 16 bp, Zea mays
aggcaaggtacacacc

SEQ ID NO: 849 - DNA, 25 bp, Zea mays
tctactgttaggcagtctcggaaag

SEQ ID NO: 850 - DNA, 25 bp, Zea mays
acttgaggctgaagctactgcttta

SEQ ID NO: 851 - DNA, 13 bp, Zea mays
ctgccccagtttg

SEQ ID NO: 852 - DNA, 15 bp, Zea mays
cagctgcctcagttt

SEQ ID NO: 853 - DNA, 21 bp, Zea mays
tgtggctctggtggatatcca

SEQ ID NO: 854 - DNA, 21 bp, Zea mays
gcttcgcaacttggtttagca

SEQ ID NO: 855 - DNA, 14 bp, Zea mays
aaccaaaaatctcc

SEQ ID NO: 856 - DNA, 14 bp, Zea mays
aaaccagaaatctc

SEQ ID NO: 857 - DNA, 15 bp, Zea mays
ccggaggcgatggca

SEQ ID NO: 858 - DNA, 16 bp, Zea mays
gcccggcgaggatacg

SEQ ID NO: 859 - DNA, 15 bp, Zea mays
aagggtagcgtatgc

SEQ ID NO: 860 - DNA, 14 bp, Zea mays
agggtagcgaatgc

SEQ ID NO: 861 - DNA, 21 bp, Zea mays
tttggttttgacccctgacaa

SEQ ID NO: 862 - DNA, 18 bp, Zea mays
ggcaggtgctggaaatcg

SEQ ID NO: 863 - DNA, 13 bp, Zea mays
tgcctgggcaagg

SEQ ID NO: 864 - DNA, 14 bp, Zea mays
tgggctaggcacct

SEQ ID NO: 865 - DNA, 22 bp, Zea mays
acccaccattgtgtgtgtgtct

SEQ ID NO: 866 - DNA, 27 bp, Zea mays
gatgtaactggcctctctagttcagaa

SEQ ID NO: 867 - DNA, 15 bp, Zea mays
ctccctcccacacac

SEQ ID NO: 868 - DNA, 14 bp, Zea mays
ccctcacacacacc

SEQ ID NO: 869 - DNA, 25 bp, Zea mays
ttttatgccttacacggttgttttc

SEQ ID NO: 870 - DNA, 24 bp, Zea mays
cgtcttgaaattgcctgaaatagg

SEQ ID NO: 871 - DNA, 14 bp, Zea mays
cagcacataaggtc

SEQ ID NO: 872 - DNA, 15 bp, Zea mays
cagcacataatgtct

SEQ ID NO: 873 - DNA, 28 bp, Zea mays
aaatttcaatgtaaactttgatgaccat

SEQ ID NO: 874 - DNA, 28 bp, Zea mays
cagacccgctatatgatttctatgttaa

SEQ ID NO: 875 - DNA, 16 bp, Zea mays
cctaaaagaagaattc

SEQ ID NO: 876 - DNA, 16 bp, Zea mays
cctaaaagaaaaattc

SEQ ID NO: 877 - DNA, 27 bp, Zea mays
gcaaagaaagagaagagatgaatacca

SEQ ID NO: 878 - DNA, 23 bp, Zea mays
cattacctttgctgccgtctcta

SEQ ID NO: 879 - DNA, 15 bp, Zea mays
agcagtagcacccac

SEQ ID NO: 880 - DNA, 15 bp, Zea mays
agaagcagtggcacc

SEQ ID NO: 881 - DNA, 23 bp, Zea mays
tgctttctctctgctcaacattg

SEQ ID NO: 882 - DNA, 26 bp, Zea mays
cagtcataataattcccattccacaa

SEQ ID NO: 883 - DNA, 15 bp, Zea mays
cttgtacacattttc

SEQ ID NO: 884 - DNA, 16 bp, Zea mays
cttgtactcattttca

SEQ ID NO: 885 - DNA, 25 bp, Zea mays
gacattctcaacatggagtgatgat

SEQ ID NO: 886 - DNA, 20 bp, Zea mays
gcaagcatgagccacacaag

SEQ ID NO: 887 - DNA, 17 bp, Zea mays
cactgctgtatgtgttt

SEQ ID NO: 888 - DNA, 15 bp, Zea mays
cactgccgtatgtgt

SEQ ID NO: 889 - DNA, 19 bp, Zea mays
ggtctacgggcggaccata

SEQ ID NO: 890 - DNA, 18 bp, Zea mays
gatcggaggctggccagt

SEQ ID NO: 891 - DNA, 15 bp, Zea mays
ctccaatcaatgatg

SEQ ID NO: 892 - DNA, 16 bp, Zea mays
cctccaattaatgatg

SEQ ID NO: 893 - DNA, 22 bp, Zea mays
ctggacaaaaaagcatgcacat

SEQ ID NO: 894 - DNA, 20 bp, Zea mays
ggcgtccgagtttgtaggaa

SEQ ID NO: 895 - DNA, 14 bp, Zea mays
tgtgggagtgattc

SEQ ID NO: 896 - DNA, 13 bp, Zea mays
tgggagcgattct

SEQ ID NO: 897 - DNA, 24 bp, Zea mays
atgcacatctccttgtatccagaa

SEQ ID NO: 898 - DNA, 24 bp, Zea mays
tgtgcttgtactcctggattatgg

SEQ ID NO: 899 - DNA, 16 bp, Zea mays
tgaatcatcaaaaaca

SEQ ID NO: 900 - DNA, 15 bp, Zea mays
tgaatcgtcaaaaac

SEQ ID NO: 901 - DNA, 19 bp, Zea mays
ccgcaaagcaacaaatcga

SEQ ID NO: 902 - DNA, 21 bp, Zea mays
gccgtgtgtgaagcattttct

SEQ ID NO: 903 - DNA, 13 bp, Zea mays
ctcccgcgtgcat

SEQ ID NO: 904 - DNA, 14 bp, Zea mays
ctcccgagtgcatc

SEQ ID NO: 905 - DNA, 22 bp, Zea mays
ttgtgacgtgttcatcccactt

SEQ ID NO: 906 - DNA, 20 bp, Zea mays
aaccacgttaggccatgctt

SEQ ID NO: 907 - DNA, 16 bp, Zea mays
cgttctgttggtttaa

SEQ ID NO: 908 - DNA, 16 bp, Zea mays
cgttctgttgttttaa

SEQ ID NO: 909 - DNA, 23 bp, Zea mays
aagcaagcttttcaattccttca

SEQ ID NO: 910 - DNA, 21 bp, Zea mays
gccttcttcaagcgaaggatt

SEQ ID NO: 911 - DNA, 17 bp, Zea mays
attgtactcatctcttg

SEQ ID NO: 912 - DNA, 18 bp, Zea mays
tgttgctattgtattcat

SEQ ID NO: 913 - DNA, 22 bp, Zea mays
cacactgatgcttttgctcgaa

SEQ ID NO: 914 - DNA, 25 bp, Zea mays
cagctcttacatcgatgacaagttg

SEQ ID NO: 915 - DNA, 21 bp, Zea mays
cattcttggtaacagtagtaa

SEQ ID NO: 916 - DNA, 17 bp, Zea mays
cttggtaacagaagtaa

SEQ ID NO: 917 - DNA, 21 bp, Zea mays
cagcttcgcccagttacagtt

SEQ ID NO: 918 - DNA, 24 bp, Zea mays
gtcatctggggactacactttgtg

SEQ ID NO: 919 - DNA, 13 bp, Zea mays
tgggcagggtacg

SEQ ID NO: 920 - DNA, 14 bp, Zea mays
tgggcaaggtacgc

SEQ ID NO: 921 - DNA, 26 bp, Zea mays
tgaccatttcatatggaatattggtt

SEQ ID NO: 922 - DNA, 20 bp, Zea mays
catggcgatagcagtttcca

SEQ ID NO: 923 - DNA, 14 bp, Zea mays
tcttcgcataactc

SEQ ID NO: 924 - DNA, 16 bp, Zea mays
atcttcacataactcc

SEQ ID NO: 925 - DNA, 27 bp, Zea mays
gcatattctgtcatcttctccagtaaa

SEQ ID NO: 926 - DNA, 24 bp, Zea mays
catatccttcaactcaggcaaagg

SEQ ID NO: 927 - DNA, 14 bp, Zea mays
cgaacagcactatc

SEQ ID NO: 928 - DNA, 16 bp, Zea mays
cgaacaacactatcac

SEQ ID NO: 929 - DNA, 23 bp, Zea mays
cggtaaggttagcgaagtggttt

SEQ ID NO: 930 - DNA, 20 bp, Zea mays
gctgcgtctacgggattcag

SEQ ID NO: 931 - DNA, 18 bp, Zea mays
cgagagaatactcaagac

SEQ ID NO: 932 - DNA, 15 bp, Zea mays
cgatcgagaggatac

SEQ ID NO: 933 - DNA, 26 bp, Zea mays
ttgtaagtacacagccatattttgca

SEQ ID NO: 934 - DNA, 22 bp, Zea mays
gcagaaatgccaacacaaggtt

SEQ ID NO: 935 - DNA, 19 bp, Zea mays
agtagtaaagtgataaatt

SEQ ID NO: 936 - DNA, 18 bp, Zea mays
tagtaaggtgataaattg

SEQ ID NO: 937 - DNA, 17 bp, Zea mays
tccgagctggtcacgca

SEQ ID NO: 938 - DNA, 21 bp, Zea mays
gctggacaggtggatgatctg

SEQ ID NO: 939 - DNA, 13 bp, Zea mays
aggcaagcactcc

SEQ ID NO: 940 - DNA, 14 bp, Zea mays
tgaggcaaacactc

SEQ ID NO: 941 - DNA, 16 bp, Zea mays
gccgccagcacgaaca

SEQ ID NO: 942 - DNA, 20 bp, Zea mays
ggctgacggacatgaacatg

SEQ ID NO: 943 - DNA, 13 bp, Zea mays
tacgggaagatcg

SEQ ID NO: 944 - DNA, 13 bp, Zea mays
tacgggaaggtcg

SEQ ID NO: 945 - DNA, 20 bp, Zea mays
ctgcagaagccatcattcga

SEQ ID NO: 946 - DNA, 26 bp, Zea mays
cagtggcaagatagttgtcgtatttg

SEQ ID NO: 947 - DNA, 14 bp, Zea mays
tactgcgagccaat

SEQ ID NO: 948 - DNA, 16 bp, Zea mays
tgggtactgtgagcca

SEQ ID NO: 949 - DNA, 20 bp, Zea mays
tccctctagcccctcgtctc

SEQ ID NO: 950 - DNA, 16 bp, Zea mays
ggctggcaccgatgga

SEQ ID NO: 951 - DNA, 16 bp, Zea mays
acaccgtctacaccag

SEQ ID NO: 952 - DNA, 14 bp, Zea mays
ccgtccacaccagg

SEQ ID NO: 953 - DNA, 22 bp, Zea mays
gccaaatctcggcatcagtatt

SEQ ID NO: 954 - DNA, 23 bp, Zea mays
ttcaagcctgatattgggtttca

SEQ ID NO: 955 - DNA, 15 bp, Zea mays
catagcgctgaacca

SEQ ID NO: 956 - DNA, 16 bp, Zea mays
tgcatagagctgaacc

SEQ ID NO: 957 - DNA, 22 bp, Zea mays
aaatcctcccagggtttatcca

SEQ ID NO: 958 - DNA, 23 bp, Zea mays
agagtctggcggtgtattttgac

SEQ ID NO: 959 - DNA, 16 bp, Zea mays
caatccaaggactgct

SEQ ID NO: 960 - DNA, 16 bp, Zea mays
tccaagaactgctatc

SEQ ID NO: 961 - DNA, 26 bp, Zea mays
gccttctggtcaaattaagttgaaag

SEQ ID NO: 962 - DNA, 25 bp, Zea mays
tcaaaagctcctgctcactcttagt

SEQ ID NO: 963 - DNA, 16 bp, Zea mays
agcatcagattgtttg

SEQ ID NO: 964 - DNA, 15 bp, Zea mays
agagcatcaaattgt

SEQ ID NO: 965 - DNA, 16 bp, Zea mays
ctgcggcgacgaagga

SEQ ID NO: 966 - DNA, 20 bp, Zea mays
cgctgcctccgagttctcta

SEQ ID NO: 967 - DNA, 15 bp, Zea mays
cgatgatcagtttct

SEQ ID NO: 968 - DNA, 14 bp, Zea mays
cgatgaccagtttc

SEQ ID NO: 969 - DNA, 22 bp, Zea mays
tttcaggtgccatagactgcaa

SEQ ID NO: 970 - DNA, 26 bp, Zea mays
gtcatcagcaaaatttgagatacgat

SEQ ID NO: 971 - DNA, 15 bp, Zea mays
ctgctcttgcttagc

SEQ ID NO: 972 - DNA, 14 bp, Zea mays
tgctcctgcttagc

SEQ ID NO: 973 - DNA, 22 bp, Zea mays
tgaactgcaacatgctgaaacc

SEQ ID NO: 974 - DNA, 26 bp, Zea mays
gctttttgaaccatgtatcagagaaa

SEQ ID NO: 975 - DNA, 14 bp, Zea mays
ccaaccacaactta

SEQ ID NO: 976 - DNA, 14 bp, Zea mays
ccaaccacaattta

SEQ ID NO: 977 - DNA, 19 bp, Zea mays
tcctgcatcggcagaactg

SEQ ID NO: 978 - DNA, 23 bp, Zea mays
cgtggtaaacaacaaacgaacga

SEQ ID NO: 979 - DNA, 16 bp, Zea mays
tgaagaatggcatttc

SEQ ID NO: 980 - DNA, 13 bp, Zea mays
cctgaagaaaggc

SEQ ID NO: 981 - DNA, 25 bp, Zea mays
tcaataccgatgatgttcacaaatc

SEQ ID NO: 982 - DNA, 22 bp, Zea mays
gtgggcaatggaaatgaaattc

SEQ ID NO: 983 - DNA, 16 bp, Zea mays
cagcacattgacagtt

SEQ ID NO: 984 - DNA, 16 bp, Zea mays
cagcacaatgacagtt

SEQ ID NO: 985 - DNA, 20 bp, Zea mays
ggcactgaagtcgcttgatg

SEQ ID NO: 986 - DNA, 27 bp, Zea mays
cacagccatgcttacttatttaaacaa

SEQ ID NO: 987 - DNA, 15 bp, Zea mays
catcacaaacaattc

SEQ ID NO: 988 - DNA, 15 bp, Zea mays
atcacgaacaattca

SEQ ID NO: 989 - DNA, 25 bp, Zea mays
cttaggcatctaggtctggttgcta

SEQ ID NO: 990 - DNA, 24 bp, Zea mays
actggacgttagatctgcacaaga

SEQ ID NO: 991 - DNA, 15 bp, Zea mays
cttttggcgattgga

SEQ ID NO: 992 - DNA, 15 bp, Zea mays
cttttcgcgattgga

SEQ ID NO: 993 - DNA, 24 bp, Zea mays
gaaaccgaactggtcctactcaaa

SEQ ID NO: 994 - DNA, 23 bp, Zea mays
ccctatattcatgaggcgaagaa

SEQ ID NO: 995 - DNA, 15 bp, Zea mays
aggccatttcattgc

SEQ ID NO: 996 - DNA, 14 bp, Zea mays
aggccatgtcattg

SEQ ID NO: 997 - DNA, 16 bp, Zea mays
gcacgcatcgcccaaa

SEQ ID NO: 998 - DNA, 25 bp, Zea mays
gagatatgtggttctggaagaatcc

SEQ ID NO: 999 - DNA, 14 bp, Zea mays
tcgcattgcattgc

SEQ ID NO: 1000 - DNA, 15 bp, Zea mays
cttcgcaatgcattg

SEQ ID NO: 1001 - DNA, 20 bp, Zea mays
gctgccgatgtcatcttcct

SEQ ID NO: 1002 - DNA, 17 bp, Zea mays
ggcgcctgtggatggat

SEQ ID NO: 1003 - DNA, 13 bp, Zea mays
atggtcggtttcc

SEQ ID NO: 1004 - DNA, 13 bp, Zea mays
atggtcggcttcc

SEQ ID NO: 1005 - DNA, 21 bp, Zea mays
gcagcattggctgtgaaccta

SEQ ID NO: 1006 - DNA, 25 bp, Zea mays
cactaacgctgacagaaaagacaag

SEQ ID NO: 1007 - DNA, 15 bp, Zea mays
caaccatgtggtctt

SEQ ID NO: 1008 - DNA, 14 bp, Zea mays
aaccacgtggtctt

SEQ ID NO: 1009 - DNA, 20 bp, Zea mays
catagtctgcaccgccaact

SEQ ID NO: 1010 - DNA, 25 bp, Zea mays
gactgtgttatgctcagtggtgaga

SEQ ID NO: 1011 - DNA, 15 bp, Zea mays
tggataggccccagc

SEQ ID NO: 1012 - DNA, 13 bp, Zea mays
ctggataagcccc

SEQ ID NO: 1013 - DNA, 20 bp, Zea mays
cagctcaccagcggaaaatc

SEQ ID NO: 1014 - DNA, 20 bp, Zea mays
cgctgctctgctaggaacaa

SEQ ID NO: 1015 - DNA, 16 bp, Zea mays
cagaacaacatattgc

SEQ ID NO: 1016 - DNA, 16 bp, Zea mays
cagaacaacgtattgc

SEQ ID NO: 1017 - DNA, 20 bp, Zea mays
cagctcaccagcggaaaatc

SEQ ID NO: 1018 - DNA, 20 bp, Zea mays
cgctgctctgctaggaacaa

SEQ ID NO: 1019 - DNA, 16 bp, Zea mays
cagaacaacatattgc

SEQ ID NO: 1020 - DNA, 16 bp, Zea mays
cagaacaacgtattgc

SEQ ID NO: 1021 - DNA, 24 bp, Zea mays
tccattacagatgaccgaaatgag

SEQ ID NO: 1022 - DNA, 30 bp, Zea mays
tcctgctatttttagctaccacatatagac

SEQ ID NO: 1023 - DNA, 18 bp, Zea mays
tttcaaatcagatattgc

SEQ ID NO: 1024 - DNA, 18 bp, Zea mays
tttcaattcagatattgc

SEQ ID NO: 1025 - DNA, 20 bp, Zea mays
tgccctcctaacccaaacct

SEQ ID NO: 1026 - DNA, 21 bp, Zea mays
cctctttctcgtcggtttgct

SEQ ID NO: 1027 - DNA, 15 bp, Zea mays
aggtcggtgtggaca

SEQ ID NO: 1028 - DNA, 16 bp, Zea mays
aggtcgatgtggacag

SEQ ID NO: 1029 - DNA, 20 bp, Zea mays
ccacagcgcagcttgtactc

SEQ ID NO: 1030 - DNA, 25 bp, Zea mays
tgaagtactgcatcttcccaagaat

SEQ ID NO: 1031 - DNA, 14 bp, Zea mays
tcatgctgggaaaa

SEQ ID NO: 1032 - DNA, 15 bp, Zea mays
tcatgttgggaaaag

SEQ ID NO: 1033 - DNA, 28 bp, Zea mays
catctgataactgtaaaaaatgtgcaaa

SEQ ID NO: 1034 - DNA, 29 bp, Zea mays
tgtattttaacaacttatgattgcatcgt

SEQ ID NO: 1035 - DNA, 16 bp, Zea mays
caacacatggtatttg

SEQ ID NO: 1036 - DNA, 16 bp, Zea mays
aacacagggtatttgt

SEQ ID NO: 1037 - DNA, 21 bp, Zea mays
gtagcaccccctgagcttttt

SEQ ID NO: 1038 - DNA, 30 bp, Zea mays
tgaaaaatcttcactaaaagttgacctaga

SEQ ID NO: 1039 - DNA, 15 bp, Zea mays
aaagtgcaataaaac

SEQ ID NO: 1040 - DNA, 19 bp, Zea mays
actagaaagtgtaataaaa

SEQ ID NO: 1041 - DNA, 19 bp, Zea mays
gctgcctgcctgcttcttg

SEQ ID NO: 1042 - DNA, 25 bp, Zea mays
gagagaaaccaacaagatcgatcag

SEQ ID NO: 1043 - DNA, 16 bp, Zea mays
cgatcaagtaggaacc

SEQ ID NO: 1044 - DNA, 18 bp, Zea mays
caagtagaaaccttttag

SEQ ID NO: 1045 - DNA, 24 bp, Zea mays
caagagcagcacaagaagcattaa

SEQ ID NO: 1046 - DNA, 24 bp, Zea mays
ccttgtttccttgacagtgcttag

SEQ ID NO: 1047 - DNA, 15 bp, Zea mays
tgcacatggcataag

SEQ ID NO: 1048 - DNA, 16 bp, Zea mays
ttgcacatgacataag

SEQ ID NO: 1049 - DNA, 18 bp, Zea mays
cggctgtgcccaaacaac

SEQ ID NO: 1050 - DNA, 23 bp, Zea mays
gattttgctccatgctagtttcg

SEQ ID NO: 1051 - DNA, 18 bp, Zea mays
atgcttctctgttaaata

SEQ ID NO: 1052 - DNA, 17 bp, Zea mays
cttctctgttgaataga

SEQ ID NO: 1053 - DNA, 24 bp, Zea mays
gcagttggatttccttctgtagct

SEQ ID NO: 1054 - DNA, 20 bp, Zea mays
ggaagcaacagcaggctgtt

SEQ ID NO: 1055 - DNA, 14 bp, Zea mays
tgcatggaatcact

SEQ ID NO: 1056 - DNA, 16 bp, Zea mays
catggagtcactagga

SEQ ID NO: 1057 - DNA, 22 bp, Zea mays
gaccgccatcccggtattatat

SEQ ID NO: 1058 - DNA, 19 bp, Zea mays
gattttctcggccgagacc

SEQ ID NO: 1059 - DNA, 19 bp, Zea mays
caagatagactaaaacaat

SEQ ID NO: 1060 - DNA, 18 bp, Zea mays
caagatacactaaaacaa

SEQ ID NO: 1061 - DNA, 23 bp, Zea mays
tgcattgagttgaccatcatcac

SEQ ID NO: 1062 - DNA, 25 bp, Zea mays
ggttgatgcgcgtataaaatatttc

SEQ ID NO: 1063 - DNA, 16 bp, Zea mays
cctatgcgaagtgtac

SEQ ID NO: 1064 - DNA, 15 bp, Zea mays
ccctatgcaaagtgt

SEQ ID NO: 1065 - DNA, 26 bp, Zea mays
gatgttgattgtattgaggtctgtga

SEQ ID NO: 1066 - DNA, 23 bp, Zea mays
ccacagcttatggtccatttttg

SEQ ID NO: 1067 - DNA, 14 bp, Zea mays
agggagtggttgcc

SEQ ID NO: 1068 - DNA, 14 bp, Zea mays
agtggctgccaaaa

SEQ ID NO: 1069 - DNA, 26 bp, Zea mays
ttcgtacaaatagcatttgttttcgt

SEQ ID NO: 1070 - DNA, 33 bp, Zea mays
tgtatctaagttaaggtccactgatttgtaata

SEQ ID NO: 1071 - DNA, 17 bp, Zea mays
atctcaggtacgtaaac

SEQ ID NO: 1072 - DNA, 17 bp, Zea mays
tctcaggtatgtaaacc

SEQ ID NO: 1073 - DNA, 27 bp, Zea mays
gtcagcaaccctgatactagtacatca

SEQ ID NO: 1074 - DNA, 23 bp, Zea mays
ccctctttgaaatgtttgtgcaa

SEQ ID NO: 1075 - DNA, 14 bp, Zea mays
atgctacgaaactt

SEQ ID NO: 1076 - DNA, 15 bp, Zea mays
atgctacaaaacttg

SEQ ID NO: 1077 - DNA, 21 bp, Zea mays
gtctcaggcctgggaatctgt

SEQ ID NO: 1078 - DNA, 26 bp, Zea mays
tgttgttgtcaatttttttgaaaagg

SEQ ID NO: 1079 - DNA, 13 bp, Zea mays
tggccgatgtcct

SEQ ID NO: 1080 - DNA, 14 bp, Zea mays
cagctggccaatgt

SEQ ID NO: 1081 - DNA, 21 bp, Zea mays
ccagcatttcaaacgctcagt

SEQ ID NO: 1082 - DNA, 26 bp, Zea mays
agtaaaaccagtcatatttgcggaat

SEQ ID NO: 1083 - DNA, 16 bp, Zea mays
ctgtgaggatgatggt

SEQ ID NO: 1084 - DNA, 14 bp, Zea mays
ctgtgaggatggtc

SEQ ID NO: 1085 - DNA, 29 bp, Zea mays
tctcgtcaattaaacatgtcaataagatt

SEQ ID NO: 1086 - DNA, 25 bp, Zea mays
gcaaatgggctcatacaaaacttta

SEQ ID NO: 1087 - DNA, 15 bp, Zea mays
cagtgcatcaagtta

SEQ ID NO: 1088 - DNA, 15 bp, Zea mays
agtgcatcaatttaa

SEQ ID NO: 1089 - DNA, 25 bp, Zea mays
cacgagagcaaaacattaattcaca

SEQ ID NO: 1090 - DNA, 22 bp, Zea mays
acattttgcaatcgttgggttt

SEQ ID NO: 1091 - DNA, 16 bp, Zea mays
agagcagaagctaaaa

SEQ ID NO: 1092 - DNA, 15 bp, Zea mays
cagagcagaaactaa

SEQ ID NO: 1093 - DNA, 20 bp, Zea mays
cgcacagaccgatcgtacac

SEQ ID NO: 1094 - DNA, 22 bp, Zea mays
aagccgtggtggtaatcagaga

SEQ ID NO: 1095 - DNA, 15 bp, Zea mays
ctcgctgtcagttta

SEQ ID NO: 1096 - DNA, 16 bp, Zea mays
atcatctcgctttcag

SEQ ID NO: 1097 - DNA, 19 bp, Zea mays
ggcgcatgacacaaacaca

SEQ ID NO: 1098 - DNA, 25 bp, Zea mays
gctagcgctagtggtggtaaattac

SEQ ID NO: 1099 - DNA, 14 bp, Zea mays
agcatggtttcctg

SEQ ID NO: 1100 - DNA, 14 bp, Zea mays
agcatcgtttcctg

SEQ ID NO: 1101 - DNA, 25 bp, Zea mays
ggagttcaggtacttgcattgtgtt

SEQ ID NO: 1102 - DNA, 19 bp, Zea mays
cgccctgttccaaggaaac

SEQ ID NO: 1103 - DNA, 15 bp, Zea mays
caagcatagagttcc

SEQ ID NO: 1104 - DNA, 16 bp, Zea mays
agcaagcatatagttc

SEQ ID NO: 1105 - DNA, 22 bp, Zea mays
cgtctacctcgtcttcctccat

SEQ ID NO: 1106 - DNA, 24 bp, Zea mays
ggacatttgatttcaggatatcga

SEQ ID NO: 1107 - DNA, 15 bp, Zea mays
tgtctttgctgcgcc

SEQ ID NO: 1108 - DNA, 15 bp, Zea mays
tctttcctgcgcctc

SEQ ID NO: 1109 - DNA, 25 bp, Zea mays
ggaggtaatccactgaaacaacaga

SEQ ID NO: 1110 - DNA, 28 bp, Zea mays
tactctacatgtttcaagggtctgtctt

SEQ ID NO: 1111 - DNA, 16 bp, Zea mays
aggctttacaaccttt

SEQ ID NO: 1112 - DNA, 15 bp, Zea mays
caggctttgcaacct

SEQ ID NO: 1113 - DNA, 26 bp, Zea mays
tgcatgagcaagagattcttatcttt

SEQ ID NO: 1114 - DNA, 21 bp, Zea mays
gggcttcgaactccacatctc

SEQ ID NO: 1115 - DNA, 16 bp, Zea mays
tgtttgctgagattag

SEQ ID NO: 1116 - DNA, 17 bp, Zea mays
tgctgagttagttgaag

SEQ ID NO: 1117 - DNA, 25 bp, Zea mays
cctcagccacatgttagaatttgta

SEQ ID NO: 1118 - DNA, 21 bp, Zea mays
gatgcctaggcggtgataagg

SEQ ID NO: 1119 - DNA, 16 bp, Zea mays
ctatggtgtagccttt

SEQ ID NO: 1120 - DNA, 15 bp, Zea mays
ctatggcgtagcctt

SEQ ID NO: 1121 - DNA, 25 bp, Zea mays
cacatgaataggaattgcagtcaag

SEQ ID NO: 1122 - DNA, 25 bp, Zea mays
cttatgaaaatggctggaagagcta

SEQ ID NO: 1123 - DNA, 13 bp, Zea mays
ttgggtcaaattt

SEQ ID NO: 1124 - DNA, 13 bp, Zea mays
ttgggtgaaattt

SEQ ID NO: 1125 - DNA, 30 bp, Zea mays
gacaaataataacagctgcatatagctctt

SEQ ID NO: 1126 - DNA, 27 bp, Zea mays
ggtctgtgtttgttatttgtttagcaa

SEQ ID NO: 1127 - DNA, 16 bp, Zea mays
ctctacccatagtttc

SEQ ID NO: 1128 - DNA, 19 bp, Zea mays
agttcaactctactcatag

SEQ ID NO: 1129 - DNA, 23 bp, Zea mays
ttggagaggtctctttcgttcag

SEQ ID NO: 1130 - DNA, 20 bp, Zea mays
gccactgctttctgcttcgt

SEQ ID NO: 1131 - DNA, 16 bp, Zea mays
aggatgactacttctc

SEQ ID NO: 1132 - DNA, 16 bp, Zea mays
aggatgaatacttctc

SEQ ID NO: 1133 - DNA, 17 bp, Zea mays
cgccagcgcctttgatg

SEQ ID NO: 1134 - DNA, 15 bp, Zea mays
ggcggaggggttggg

SEQ ID NO: 1135 - DNA, 15 bp, Zea mays
tgtggtgaccctcta

SEQ ID NO: 1136 - DNA, 15 bp, Zea mays
tctgtggtaaccctc

SEQ ID NO: 1137 - DNA, 24 bp, Zea mays
cagtttggtgaaattggagaaaaa

SEQ ID NO: 1138 - DNA, 22 bp, Zea mays
caacccgttgacctgtaaaagc

SEQ ID NO: 1139 - DNA, 14 bp, Zea mays
acgaaccaagcttt

SEQ ID NO: 1140 - DNA, 15 bp, Zea mays
aacgaaccaagtttt

SEQ ID NO: 1141 - DNA, 24 bp, Zea mays
ccggtaaaatgtcctctaccctaa

SEQ ID NO: 1142 - DNA, 17 bp, Zea mays
cctacagccggcatgca

SEQ ID NO: 1143 - DNA, 16 bp, Zea mays
tgtgtcttgtaaggct

SEQ ID NO: 1144 - DNA, 15 bp, Zea mays
tgtgtcctgtaaggc

SEQ ID NO: 1145 - DNA, 27 bp, Zea mays
ggtttcgcttttgttctgtctagtaaa

SEQ ID NO: 1146 - DNA, 25 bp, Zea mays
tcagacaaatgatgaagacgaagaa

SEQ ID NO: 1147 - DNA, 16 bp, Zea mays
tggtgactttgactcc

SEQ ID NO: 1148 - DNA, 15 bp, Zea mays
tgactctgactcctt

SEQ ID NO: 1149 - DNA, 33 bp, Zea mays
ataaaaagacaatattagtaggatgttgaatca

SEQ ID NO: 1150 - DNA, 21 bp, Zea mays
tttgggcaatatggaaaacca

SEQ ID NO: 1151 - DNA, 17 bp, Zea mays
tgcttgttttcattcta

SEQ ID NO: 1152 - DNA, 17 bp, Zea mays
tgcttgttttcatttta

SEQ ID NO: 1153 - DNA, 23 bp, Zea mays
ggagttaccacatctggaaggaa

SEQ ID NO: 1154 - DNA, 24 bp, Zea mays
tgccagcaatgtctattatcgaat

SEQ ID NO: 1155 - DNA, 16 bp, Zea mays
aaggtgtgggtgacaa

SEQ ID NO: 1156 - DNA, 15 bp, Zea mays
aggtgtgcgtgacaa

SEQ ID NO: 1157 - DNA, 22 bp, Zea mays
gagtgcaggtcatcagtttgga

SEQ ID NO: 1158 - DNA, 22 bp, Zea mays
gctgtggtttcaaggagaagct

SEQ ID NO: 1159 - DNA, 14 bp, Zea mays
agctgcattatggc

SEQ ID NO: 1160 - DNA, 15 bp, Zea mays
agagctgcactatgg

SEQ ID NO: 1161 - DNA, 27 bp, Zea mays
tgtttctagctgtcttgctttcttaaa

SEQ ID NO: 1162 - DNA, 27 bp, Zea mays
gcctagtacaaatctacgcaaaaagtc

SEQ ID NO: 1163 - DNA, 16 bp, Zea mays
agttccgattgctttg

SEQ ID NO: 1164 - DNA, 14 bp, Zea mays
cagttccaattgct

SEQ ID NO: 1165 - DNA, 25 bp, Zea mays
aaggcaccttagctgtaaagtcaag

SEQ ID NO: 1166 - DNA, 31 bp, Zea mays
ttctttgctaaatatcttttacattccttct

SEQ ID NO: 1167 - DNA, 16 bp, Zea mays
ctgctggaacatgtat

SEQ ID NO: 1168 - DNA, 14 bp, Zea mays
actgctgaaacatg

SEQ ID NO: 1169 - DNA, 17 bp, Zea mays
tgtggcgctgcaacgat

SEQ ID NO: 1170 - DNA, 22 bp, Zea mays
ccagacgaactgtggagctctt

SEQ ID NO: 1171 - DNA, 15 bp, Zea mays
agcttcgtgttcgtg

SEQ ID NO: 1172 - DNA, 14 bp, Zea mays
cttcgcgttcgtgc

SEQ ID NO: 1173 - DNA, 22 bp, Zea mays
aacaacgatcctgcctttccta

SEQ ID NO: 1174 - DNA, 28 bp, Zea mays
gctcctagctcccatttctattctatat

SEQ ID NO: 1175 - DNA, 15 bp, Zea mays
aacacacgcacacaa

SEQ ID NO: 1176 - DNA, 15 bp, Zea mays
acacacacacacaaa

SEQ ID NO: 1177 - DNA, 20 bp, Zea mays
ctgcatcatccgtcgttctg

SEQ ID NO: 1178 - DNA, 17 bp, Zea mays
ggccgccggtcagtcta

SEQ ID NO: 1179 - DNA, 15 bp, Zea mays
cgagcgagtgagaga

SEQ ID NO: 1180 - DNA, 14 bp, Zea mays
agcgagagacctag

SEQ ID NO: 1181 - DNA, 18 bp, Zea mays
gacccatgcatgcatgct

SEQ ID NO: 1182 - DNA, 18 bp, Zea mays
ggacgacggtggctagct

SEQ ID NO: 1183 - DNA, 14 bp, Zea mays
cggtaggcacacgg

SEQ ID NO: 1184 - DNA, 15 bp, Zea mays
cggtaggaacacggt

SEQ ID NO: 1185 - DNA, 19 bp, Zea mays
ttgcggacgaacctgacat

SEQ ID NO: 1186 - DNA, 18 bp, Zea mays
gcgaccaggcgacaagac

SEQ ID NO: 1187 - DNA, 14 bp, Zea mays
tgctgttgctgctg

SEQ ID NO: 1188 - DNA, 13 bp, Zea mays
tgctgctgctgct

SEQ ID NO: 1189 - DNA, 17 bp, Zea mays
ggagccggaggagcgta

SEQ ID NO: 1190 - DNA, 19 bp, Zea mays
gcagccagcatcgatgaaa

SEQ ID NO: 1191 - DNA, 13 bp, Zea mays
cagcagccattcc

SEQ ID NO: 1192 - DNA, 13 bp, Zea mays
cagcagccgttcc

SEQ ID NO: 1193 - DNA, 24 bp, Zea mays
catctttgacttgctcgagaggta

SEQ ID NO: 1194 - DNA, 25 bp, Zea mays
ggagattaaagacgaggacctaagc

SEQ ID NO: 1195 - DNA, 15 bp, Zea mays
agacaaaagaaaaac

SEQ ID NO: 1196 - DNA, 16 bp, Zea mays
aagacataagaaaaac

SEQ ID NO: 1197 - DNA, 16 bp, Zea mays
gcggacgagggttccc

SEQ ID NO: 1198 - DNA, 22 bp, Zea mays
cacgttgctgtactgtcacgaa

SEQ ID NO: 1199 - DNA, 14 bp, Zea mays
aggcatggaaccta

SEQ ID NO: 1200 - DNA, 13 bp, Zea mays
aggcacggaacct

SEQ ID NO: 1201 - DNA, 22 bp, Zea mays
tccagtgatcctgatggctatg

SEQ ID NO: 1202 - DNA, 26 bp, Zea mays
agggtacgtgaagaacgtgtatgtag

SEQ ID NO: 1203 - DNA, 15 bp, Zea mays
aacgttgtcgaagct

SEQ ID NO: 1204 - DNA, 15 bp, Zea mays
aaacgtcgtcgaagc

SEQ ID NO: 1205 - DNA, 25 bp, Zea mays
cggagagtgatgttcagagaaaaga

SEQ ID NO: 1206 - DNA, 16 bp, Zea mays
ccggtgcctccatgct

SEQ ID NO: 1207 - DNA, 15 bp, Zea mays
aagctttgccaatgc

SEQ ID NO: 1208 - DNA, 15 bp, Zea mays
tcaagcttcgccaat

SEQ ID NO: 1209 - DNA, 22 bp, Zea mays
tcaggtacctgctgctttcaga

SEQ ID NO: 1210 - DNA, 20 bp, Zea mays
agggccaatgcaacattcat

SEQ ID NO: 1211 - DNA, 17 bp, Zea mays
acttactcctgattcaa

SEQ ID NO: 1212 - DNA, 16 bp, Zea mays
acttacccctgattca

SEQ ID NO: 1213 - DNA, 26 bp, Zea mays
gctgaaggtctctcaaatgtgtactg

SEQ ID NO: 1214 - DNA, 26 bp, Zea mays
caattgtacaccatatgctctagcaa

SEQ ID NO: 1215 - DNA, 15 bp, Zea mays
tcaggcaacattaaa

SEQ ID NO: 1216 - DNA, 17 bp, Zea mays
ttcaggtaacattaaac

SEQ ID NO: 1217 - DNA, 18 bp, Zea mays
ccagtgcgggtggatctg

SEQ ID NO: 1218 - DNA, 20 bp, Zea mays
caggcggattgggtaaggtt

SEQ ID NO: 1219 - DNA, 14 bp, Zea mays
ctgctcggtgctgg

SEQ ID NO: 1220 - DNA, 13 bp, Zea mays
ctgctcggtgccg

SEQ ID NO: 1221 - DNA, 19 bp, Zea mays
gtcgtctcccatgcatcgt

SEQ ID NO: 1222 - DNA, 19 bp, Zea mays
gcttggcggtgaagttgtg

SEQ ID NO: 1223 - DNA, 16 bp, Zea mays
cttccactacatcgac

SEQ ID NO: 1224 - DNA, 15 bp, Zea mays
acgcttccaatacat

SEQ ID NO: 1225 - DNA, 22 bp, Zea mays
tgatcctgaacaacacccaaca

SEQ ID NO: 1226 - DNA, 18 bp, Zea mays
ccctgggtggtgggagaa

SEQ ID NO: 1227 - DNA, 16 bp, Zea mays
attcactagcgcaacc

SEQ ID NO: 1228 - DNA, 16 bp, Zea mays
attcactaccgcaacc

SEQ ID NO: 1229 - DNA, 32 bp, Zea mays
gctaagtatctactatgaagctcaaggtaagg

SEQ ID NO: 1230 - DNA, 22 bp, Zea mays
gccgtgtaggaacaacagtgaa

SEQ ID NO: 1231 - DNA, 18 bp, Zea mays
atacatctaacaacttca

SEQ ID NO: 1232 - DNA, 20 bp, Zea mays
aaatacatctaaaaacttca

SEQ ID NO: 1233 - DNA, 33 bp, Zea mays
ggaagtatattttaatatcttgagaactgttga

SEQ ID NO: 1234 - DNA, 25 bp, Zea mays
tgtgatttgtagcattctggcaata

SEQ ID NO: 1235 - DNA, 16 bp, Zea mays
ttgcttcctaaactac

SEQ ID NO: 1236 - DNA, 14 bp, Zea mays
tgcttccgaaacta

SEQ ID NO: 1237 - DNA, 22 bp, Zea mays
acaccacaaaccatggaaggat

SEQ ID NO: 1238 - DNA, 24 bp, Zea mays
cgctgaagctttcttagtttccaa

SEQ ID NO: 1239 - DNA, 18 bp, Zea mays
tgggtacatatagaagaa

SEQ ID NO: 1240 - DNA, 16 bp, Zea mays
tgggtacataaagaag

SEQ ID NO: 1241 - DNA, 21 bp, Zea mays
gatgattcggaggaggaaagc

SEQ ID NO: 1242 - DNA, 18 bp, Zea mays
cggcctgagcatcttgga

SEQ ID NO: 1243 - DNA, 16 bp, Zea mays
agtggtttcctcgcac

SEQ ID NO: 1244 - DNA, 15 bp, Zea mays
agtggttccctcgca

SEQ ID NO: 1245 - DNA, 28 bp, Zea mays
gtgaagagcaattggttcaagtagtaaa

SEQ ID NO: 1246 - DNA, 26 bp, Zea mays
ggtggtggaaatatttgagatggtaa

SEQ ID NO: 1247 - DNA, 18 bp, Zea mays
tgctttaaattaaaaaat

SEQ ID NO: 1248 - DNA, 20 bp, Zea mays
ttgctttaaattataaaatc

SEQ ID NO: 1249 - DNA, 24 bp, Zea mays
ctatgatcccagtcccagaaattc

SEQ ID NO: 1250 - DNA, 30 bp, Zea mays
tattagaatttcttttgttggacaaaaaaa

SEQ ID NO: 1251 - DNA, 15 bp, Zea mays
ctgtcagtcatgctt

SEQ ID NO: 1252 - DNA, 15 bp, Zea mays
ctgtctgtcatgctt

SEQ ID NO: 1253 - DNA, 17 bp, Zea mays
gcacgagctggctggtg

SEQ ID NO: 1254 - DNA, 18 bp, Zea mays
agccacagcccacaggtg

SEQ ID NO: 1255 - DNA, 15 bp, Zea mays
tgaccgtctgattgg

SEQ ID NO: 1256 - DNA, 16 bp, Zea mays
ctgaccgtctgattag

SEQ ID NO: 1257 - DNA, 21 bp, Zea mays
cgacggtctcctcacctagct

SEQ ID NO: 1258 - DNA, 17 bp, Zea mays
gcacggacaccgagctg

SEQ ID NO: 1259 - DNA, 13 bp, Zea mays
tggccctgttccg

SEQ ID NO: 1260 - DNA, 14 bp, Zea mays
tggccttgttccgg

SEQ ID NO: 1261 - DNA, 18 bp, Zea mays
gcaagggccacgagaggt

SEQ ID NO: 1262 - DNA, 19 bp, Zea mays
ggcggtggtcatctcatca

SEQ ID NO: 1263 - DNA, 14 bp, Zea mays
tctggtggcaccgc

SEQ ID NO: 1264 - DNA, 14 bp, Zea mays
tcgtctggcaccgc

SEQ ID NO: 1265 - DNA, 25 bp, Zea mays
ttcgtggaattcaccagatctatct

SEQ ID NO: 1266 - DNA, 20 bp, Zea mays
ggcgggaaggtactggtttc

SEQ ID NO: 1267 - DNA, 16 bp, Zea mays
tgtttccctgtttctt

SEQ ID NO: 1268 - DNA, 16 bp, Zea mays
ctgtttccttgtttct

SEQ ID NO: 1269 - DNA, 24 bp, Zea mays
ccgcaatcattaggatgtaaacac

SEQ ID NO: 1270 - DNA, 26 bp, Zea mays
tcattctgaagactagctgtctgtga

SEQ ID NO: 1271 - DNA, 17 bp, Zea mays
aatgcatactgttaacc

SEQ ID NO: 1272 - DNA, 15 bp, Zea mays
atgcatgctgttaac

SEQ ID NO: 1273 - DNA, 24 bp, Zea mays
gctcatcagcacaaaagtcaaaat

SEQ ID NO: 1274 - DNA, 29 bp, Zea mays
gctgtgcatatatatacatccaagcctat

SEQ ID NO: 1275 - DNA, 19 bp, Zea mays
atatgcttttaagtaatcg

SEQ ID NO: 1276 - DNA, 19 bp, Zea mays
aatatgctttaagtaatcg

SEQ ID NO: 1277 - DNA, 22 bp, Zea mays
tcggccgtatcagatctgttct

SEQ ID NO: 1278 - DNA, 24 bp, Zea mays
gtttgttacgcctaccatgtctga

SEQ ID NO: 1279 - DNA, 15 bp, Zea mays
cagacacctgaaaaa

SEQ ID NO: 1280 - DNA, 15 bp, Zea mays
cagacacctggaaaa

SEQ ID NO: 1281 - DNA, 21 bp, Zea mays
gcaaggagacctgggaagatg

SEQ ID NO: 1282 - DNA, 19 bp, Zea mays
aacacatccggcacaatgc

SEQ ID NO: 1283 - DNA, 14 bp, Zea mays
acgatgagggcatg

SEQ ID NO: 1284 - DNA, 15 bp, Zea mays
cacgatgatggcatg

SEQ ID NO: 1285 - DNA, 21 bp, Zea mays
tgactcccttgatgccacttg

SEQ ID NO: 1286 - DNA, 23 bp, Zea mays
acggcatagcagtgaagttgttc

SEQ ID NO: 1287 - DNA, 15 bp, Zea mays
cctcctcaatgtttt

SEQ ID NO: 1288 - DNA, 15 bp, Zea mays
cctcctcaacgtttt

SEQ ID NO: 1289 - DNA, 22 bp, Zea mays
gacatgtgctgccatagccata

SEQ ID NO: 1290 - DNA, 21 bp, Zea mays
ccatgtgtactgtgggccaat

SEQ ID NO: 1291 - DNA, 19 bp, Zea mays
agtaggcatatataggagc

SEQ ID NO: 1292 - DNA, 16 bp, Zea mays
aggcatgtataggagc

SEQ ID NO: 1293 - DNA, 24 bp, Zea mays
ccatctcaaagcatcatcaagaaa

SEQ ID NO: 1294 - DNA, 25 bp, Zea mays
atgccgactcaaacaaatacgttat

SEQ ID NO: 1295 - DNA, 13 bp, Zea mays
ctcccaacttctg

SEQ ID NO: 1296 - DNA, 14 bp, Zea mays
tcccagcttctgca

SEQ ID NO: 1297 - DNA, 20 bp, Zea mays
cgcatgcaggaaatgaacac

SEQ ID NO: 1298 - DNA, 23 bp, Zea mays
acgcgattcagttagttcggtta

SEQ ID NO: 1299 - DNA, 14 bp, Zea mays
aatgcaggaacagc

SEQ ID NO: 1300 - DNA, 13 bp, Zea mays
atgcacgaacagc

SEQ ID NO: 1301 - DNA, 26 bp, Zea mays
gaaccctacatcacatcatctaatgc

SEQ ID NO: 1302 - DNA, 25 bp, Zea mays
cacacccttaggagtagcttctgaa

SEQ ID NO: 1303 - DNA, 17 bp, Zea mays
agaaaagagaaataaac

SEQ ID NO: 1304 - DNA, 20 bp, Zea mays
aggaataagaaaagataaat

SEQ ID NO: 1305 - DNA, 24 bp, Zea mays
tgcagtcaaaatttcagaggattg

SEQ ID NO: 1306 - DNA, 20 bp, Zea mays
atctgcccaaccgatgctaa

SEQ ID NO: 1307 - DNA, 13 bp, Zea mays
tctgcacattttc

SEQ ID NO: 1308 - DNA, 14 bp, Zea mays
ctgcacgttttcta

SEQ ID NO: 1309 - DNA, 24 bp, Zea mays
tgctaaggtcgacgtacgtacaag

SEQ ID NO: 1310 - DNA, 24 bp, Zea mays
gagctttgacacatgcgattaaaa

SEQ ID NO: 1311 - DNA, 16 bp, Zea mays
actgcatgctagctag

SEQ ID NO: 1312 - DNA, 16 bp, Zea mays
actgcatgctagtcta

SEQ ID NO: 1313 - DNA, 23 bp, Zea mays
atttggggaactagggataacca

SEQ ID NO: 1314 - DNA, 24 bp, Zea mays
atgggatgcaaactaggagtctgt

SEQ ID NO: 1315 - DNA, 14 bp, Zea mays
agcacagcatttaa

SEQ ID NO: 1316 - DNA, 15 bp, Zea mays
agcacaacatttaaa

SEQ ID NO: 1317 - DNA, 17 bp, Zea mays
acagcagcgtgcgtcgt

SEQ ID NO: 1318 - DNA, 22 bp, Zea mays
ggaggtttgcaggatctggtat

SEQ ID NO: 1319 - DNA, 17 bp, Zea mays
cagttcatcatacatca

SEQ ID NO: 1320 - DNA, 16 bp, Zea mays
ttcatcacacatcacc

SEQ ID NO: 1321 - DNA, 22 bp, Zea mays
cagcagcagtcgcagtattctg

SEQ ID NO: 1322 - DNA, 25 bp, Zea mays
ctactgaatggatcaccaaaaggat

SEQ ID NO: 1323 - DNA, 16 bp, Zea mays
caatctgggttatcca

SEQ ID NO: 1324 - DNA, 15 bp, Zea mays
caatctggattatcc

SEQ ID NO: 1325 - DNA, 26 bp, Zea mays
ccatttgacctcattattttgtacga

SEQ ID NO: 1326 - DNA, 24 bp, Zea mays
atacacacatgcaattcgcttttt

SEQ ID NO: 1327 - DNA, 15 bp, Zea mays
tcttcggattcaacc

SEQ ID NO: 1328 - DNA, 14 bp, Zea mays
cttcgggttcaacc

SEQ ID NO: 1329 - DNA, 27 bp, Zea mays
ttacacagtcgaaagtgaaaagtgatc

SEQ ID NO: 1330 - DNA, 22 bp, Zea mays
cgcttactcccatctggttgac

SEQ ID NO: 1331 - DNA, 14 bp, Zea mays
aaccggtgtcctct

SEQ ID NO: 1332 - DNA, 15 bp, Zea mays
aaaccgtgtcctctt

SEQ ID NO: 1333 - DNA, 20 bp, Zea mays
ggaggtcctcgtggatgaag

SEQ ID NO: 1334 - DNA, 19 bp, Zea mays
aactccaacgcctcctcca

SEQ ID NO: 1335 - DNA, 13 bp, Zea mays
cctgccccgccta

SEQ ID NO: 1336 - DNA, 14 bp, Zea mays
ctgccctgcctact

SEQ ID NO: 1337 - DNA, 18 bp, Zea mays
ggcggcatccaaatgatc

SEQ ID NO: 1338 - DNA, 21 bp, Zea mays
gccaacgtcgtcaacaagaaa

SEQ ID NO: 1339 - DNA, 16 bp, Zea mays
caggtacggtacagtc

SEQ ID NO: 1340 - DNA, 16 bp, Zea mays
tgcacaggtacagtac

SEQ ID NO: 1341 - DNA, 19 bp, Zea mays
ctcatctggccgggctact

SEQ ID NO: 1342 - DNA, 17 bp, Zea mays
gcgccgtgcttctcgat

SEQ ID NO: 1343 - DNA, 14 bp, Zea mays
cgtgctgtaccgct

SEQ ID NO: 1344 - DNA, 15 bp, Zea mays
acgtgctctaccgct

SEQ ID NO: 1345 - DNA, 29 bp, Zea mays
gctacgtactgtactctaaattccttgct

SEQ ID NO: 1346 - DNA, 20 bp, Zea mays
gcgagtcgctgtctcttcct

SEQ ID NO: 1347 - DNA, 16 bp, Zea mays
aaacgtgatgcgtatc

SEQ ID NO: 1348 - DNA, 16 bp, Zea mays
aaacgtcatgcgtatc

SEQ ID NO: 1349 - DNA, 16 bp, Zea mays
gcgcggccttcagctt

SEQ ID NO: 1350 - DNA, 19 bp, Zea mays
ccgtcgtcggagtcgtaca

SEQ ID NO: 1351 - DNA, 15 bp, Zea mays
cctcacctcgacggt

SEQ ID NO: 1352 - DNA, 16 bp, Zea mays
acctcaactcgacggt

SEQ ID NO: 1353 - DNA, 25 bp, Zea mays
cttggcttggctaggtacagaacta

SEQ ID NO: 1354 - DNA, 23 bp, Zea mays
tggtggcggtactgaaaactact

SEQ ID NO: 1355 - DNA, 14 bp, Zea mays
tcgtgtgtctctgc

SEQ ID NO: 1356 - DNA, 14 bp, Zea mays
ctcgtgtatctctg

SEQ ID NO: 1357 - DNA, 24 bp, Zea mays
cctaacggactactgatcgtcgat

SEQ ID NO: 1358 - DNA, 23 bp, Zea mays
cgtagagaggcgtagagctagca

SEQ ID NO: 1359 - DNA, 15 bp, Zea mays
cgactgagaacgaat

SEQ ID NO: 1360 - DNA, 16 bp, Zea mays
cgactgaaaacgaatt

SEQ ID NO: 1361 - DNA, 21 bp, Zea mays
acgactggaagcagcttttga

SEQ ID NO: 1362 - DNA, 23 bp, Zea mays
tctccttgctagctcctgtcatg

SEQ ID NO: 1363 - DNA, 14 bp, Zea mays
caggtgatttctgc

SEQ ID NO: 1364 - DNA, 14 bp, Zea mays
caggtgatctctgc

SEQ ID NO: 1365 - DNA, 26 bp, Zea mays
cgaaaaaactgtagtagcaccatctc

SEQ ID NO: 1366 - DNA, 24 bp, Zea mays
cttaagatggaggagcaagggtta

SEQ ID NO: 1367 - DNA, 15 bp, Zea mays
cgacatgaagacttt

SEQ ID NO: 1368 - DNA, 15 bp, Zea mays
acgacatgaagaatt

SEQ ID NO: 1369 - DNA, 21 bp, Zea mays
gctactgtggtttgccattgg

SEQ ID NO: 1370 - DNA, 25 bp, Zea mays
gaggtcgcttctgataattctgaaa

SEQ ID NO: 1371 - DNA, 16 bp, Zea mays
cgtttcatgattcgat

SEQ ID NO: 1372 - DNA, 16 bp, Zea mays
cgtttcatgattccat

SEQ ID NO: 1373 - DNA, 24 bp, Zea mays
cacaattcaaccattcagacatga

SEQ ID NO: 1374 - DNA, 25 bp, Zea mays
gaggatgacaagatgttgaaacaaa

SEQ ID NO: 1375 - DNA, 16 bp, Zea mays
caactgatgatttcat

SEQ ID NO: 1376 - DNA, 16 bp, Zea mays
caactgatggtttcat

SEQ ID NO: 1377 - DNA, 25 bp, Zea mays
ctacccagctcaggctatgaatatg

SEQ ID NO: 1378 - DNA, 26 bp, Zea mays
agttcttaagaaaataaggcggaaga

SEQ ID NO: 1379 - DNA, 15 bp, Zea mays
cgacacggttatgag

SEQ ID NO: 1380 - DNA, 15 bp, Zea mays
cacgacacagttatg

SEQ ID NO: 1381 - DNA, 18 bp, Zea mays
accgcgtcacccacatgt

SEQ ID NO: 1382 - DNA, 17 bp, Zea mays
tcgccgtcgaggaggat

SEQ ID NO: 1383 - DNA, 13 bp, Zea mays
ccgtcgtcttcag

SEQ ID NO: 1384 - DNA, 14 bp, Zea mays
cccgtcgtattcag

SEQ ID NO: 1385 - DNA, 35 bp, Zea mays
caacgtactctttatacatattatgttgtgactaa

SEQ ID NO: 1386 - DNA, 32 bp, Zea mays
aaagagatagctaaaataatgcatgatacaac

SEQ ID NO: 1387 - DNA, 23 bp, Zea mays
agagtttagatcatatatataaa

SEQ ID NO: 1388 - DNA, 22 bp, Zea mays
agagtttagatcatatataaat

SEQ ID NO: 1389 - DNA, 25 bp, Zea mays
gcacacaatttagaatgatggtcaa

SEQ ID NO: 1390 - DNA, 25 bp, Zea mays
ggacagccaacaataacacctttat

SEQ ID NO: 1391 - DNA, 18 bp, Zea mays
agtgcttgtttatgaatt

SEQ ID NO: 1392 - DNA, 17 bp, Zea mays
tgcttgtttaggaattt

SEQ ID NO: 1393 - DNA, 26 bp, Zea mays
tttgggtaaagaagaaggagctagaa

SEQ ID NO: 1394 - DNA, 24 bp, Zea mays
cctgtgtagagagctgctggatct

SEQ ID NO: 1395 - DNA, 16 bp, Zea mays
aaggacgtttagaatc

SEQ ID NO: 1396 - DNA, 13 bp, Zea mays
acgttcagaatcc

SEQ ID NO: 1397 - DNA, 21 bp, Zea mays
caacacgcaccaaacatctgt

SEQ ID NO: 1398 - DNA, 24 bp, Zea mays
gctgctcgatgaactctttatttg

SEQ ID NO: 1399 - DNA, 16 bp, Zea mays
cgcttgctaatataat

SEQ ID NO: 1400 - DNA, 16 bp, Zea mays
cgcttgctactataat

SEQ ID NO: 1401 - DNA, 23 bp, Zea mays
caagtgctggacagtcagtttcc

SEQ ID NO: 1402 - DNA, 23 bp, Zea mays
gccttcttctccttttgctcatc

SEQ ID NO: 1403 - DNA, 14 bp, Zea mays
agcactgaaacatc

SEQ ID NO: 1404 - DNA, 13 bp, Zea mays
agcaccgaaacat

SEQ ID NO: 1405 - DNA, 27 bp, Zea mays
gaaacaaaggtcaaacacagaatctaa

SEQ ID NO: 1406 - DNA, 25 bp, Zea mays
tgttgagtacttgagcacgatcatt

SEQ ID NO: 1407 - DNA, 16 bp, Zea mays
agtactgccgacacta

SEQ ID NO: 1408 - DNA, 15 bp, Zea mays
actgctgacactagc

SEQ ID NO: 1409 - DNA, 23 bp, Zea mays
ccttgctcgtaagttcctttgaa

SEQ ID NO: 1410 - DNA, 26 bp, Zea mays
cgttccagctgtatttagaatcaatc

SEQ ID NO: 1411 - DNA, 19 bp, Zea mays
ctgtacaaatgtagttacc

SEQ ID NO: 1412 - DNA, 18 bp, Zea mays
caaatgtagtcacctcta

SEQ ID NO: 1413 - DNA, 19 bp, Zea mays
gcctccatggatggtttcg

SEQ ID NO: 1414 - DNA, 28 bp, Zea mays
cacttgagaatagctaccaacagtcttc

SEQ ID NO: 1415 - DNA, 16 bp, Zea mays
cccttgaaacaggttt

SEQ ID NO: 1416 - DNA, 16 bp, Zea mays
ccttgaaacaggctta

SEQ ID NO: 1417 - DNA, 24 bp, Zea mays
catgaatcagaaaccacaccgata

SEQ ID NO: 1418 - DNA, 22 bp, Zea mays
ggcagtgcacaggtttcatgta

SEQ ID NO: 1419 - DNA, 15 bp, Zea mays
cgatacgatacggcg

SEQ ID NO: 1420 - DNA, 18 bp, Zea mays
tgcgatacatacgtagtc

SEQ ID NO: 1421 - DNA, 16 bp, Zea mays
gccagcgcgcttttcc

SEQ ID NO: 1422 - DNA, 19 bp, Zea mays
ctcagcacagccgctctgt

SEQ ID NO: 1423 - DNA, 15 bp, Zea mays
ctcccatccatgcag

SEQ ID NO: 1424 - DNA, 14 bp, Zea mays
tcccagccatgcag

SEQ ID NO: 1425 - DNA, 21 bp, Zea mays
cggtccttccataacgacaag

SEQ ID NO: 1426 - DNA, 21 bp, Zea mays
ccggctaaggtcaaggaaaga

SEQ ID NO: 1427 - DNA, 16 bp, Zea mays
cttccttgacggtgac

SEQ ID NO: 1428 - DNA, 15 bp, Zea mays
ttcctcgacggtgac

SEQ ID NO: 1429 - DNA, 17 bp, Zea mays
cccgcggtggaagaatt

SEQ ID NO: 1430 - DNA, 18 bp, Zea mays
cgccgacgacaggttctc

SEQ ID NO: 1431 - DNA, 14 bp, Zea mays
cttgctgtggaatc

SEQ ID NO: 1432 - DNA, 15 bp, Zea mays
aacttgcggtggaat

SEQ ID NO: 1433 - DNA, 22 bp, Zea mays
ggttaatggcgaattgctgatt

SEQ ID NO: 1434 - DNA, 23 bp, Zea mays
catgtggaaggaagaaacagctt

SEQ ID NO: 1435 - DNA, 17 bp, Zea mays
ctgcacaattataattt

SEQ ID NO: 1436 - DNA, 18 bp, Zea mays
ctgcacaattataagtac

SEQ ID NO: 1437 - DNA, 21 bp, Zea mays
cgccaatgtacgcacctgtac

SEQ ID NO: 1438 - DNA, 26 bp, Zea mays
gatttcttacactttggttctctgca

SEQ ID NO: 1439 - DNA, 19 bp, Zea mays
atgacaacaataacaaata

SEQ ID NO: 1440 - DNA, 16 bp, Zea mays
caacaacaacaaataa

SEQ ID NO: 1441 - DNA, 25 bp, Zea mays
cctagatggcgatatcaaaacaagt

SEQ ID NO: 1442 - DNA, 26 bp, Zea mays
caacctttgtatacagcgaccttaga

SEQ ID NO: 1443 - DNA, 18 bp, Zea mays
caacaatacgctagactt

SEQ ID NO: 1444 - DNA, 17 bp, Zea mays
acaatacactagacttc

SEQ ID NO: 1445 - DNA, 25 bp, Zea mays
cttgttgatgtctaaggtcgctgta

SEQ ID NO: 1446 - DNA, 21 bp, Zea mays
ggtgcccacatgttagctcat

SEQ ID NO: 1447 - DNA, 14 bp, Zea mays
aggttgcaatctga

SEQ ID NO: 1448 - DNA, 16 bp, Zea mays
ttgcaagctgatgtac

SEQ ID NO: 1449 - DNA, 25 bp, Zea mays
tgataactggttgggatttgactct

SEQ ID NO: 1450 - DNA, 25 bp, Zea mays
gaagcaagggatagataccgatgta

SEQ ID NO: 1451 - DNA, 19 bp, Zea mays
catgcttcttgttatgtta

SEQ ID NO: 1452 - DNA, 18 bp, Zea mays
tgcttcttgttgtgttat

SEQ ID NO: 1453 - DNA, 21 bp, Zea mays
gctgccagtgttttgcaccta

SEQ ID NO: 1454 - DNA, 24 bp, Zea mays
ctttaaaggcacagctgtcagtgt

SEQ ID NO: 1455 - DNA, 14 bp, Zea mays
cacaccagtgtctg

SEQ ID NO: 1456 - DNA, 16 bp, Zea mays
accacactagtgtctg

SEQ ID NO: 1457 - DNA, 21 bp, Zea mays
tctctggactgtgccattgct

SEQ ID NO: 1458 - DNA, 24 bp, Zea mays
ggtagtattggcaccaccttctca

SEQ ID NO: 1459 - DNA, 16 bp, Zea mays
cactctaggtcgcagc

SEQ ID NO: 1460 - DNA, 16 bp, Zea mays
acactcttggtcgcag

SEQ ID NO: 1461 - DNA, 20 bp, Zea mays
gcgaatcccctacgcaacta

SEQ ID NO: 1462 - DNA, 20 bp, Zea mays
ggtttgtggtggtcgattcg

SEQ ID NO: 1463 - DNA, 16 bp, Zea mays
tgtgtaccatgattca

SEQ ID NO: 1464 - DNA, 15 bp, Zea mays
tgtacccatgattgc

SEQ ID NO: 1465 - DNA, 24 bp, Zea mays
gctatctgacacctcccagtttgt

SEQ ID NO: 1466 - DNA, 25 bp, Zea mays
tttgttctcgcattgaaattttctt

SEQ ID NO: 1467 - DNA, 16 bp, Zea mays
acacgatgtaatgagg

SEQ ID NO: 1468 - DNA, 16 bp, Zea mays
cacacgatctaatgag

SEQ ID NO: 1469 - DNA, 17 bp, Zea mays
agggcgtcgaggtgcat

SEQ ID NO: 1470 - DNA, 19 bp, Zea mays
tcgtttcaccgcgatctga

SEQ ID NO: 1471 - DNA, 16 bp, Zea mays
acgacatgtaattaaa

SEQ ID NO: 1472 - DNA, 16 bp, Zea mays
acgacatgtaaactga

SEQ ID NO: 1473 - DNA, 25 bp, Zea mays
gatctaaccttcaatgtgccttacc

SEQ ID NO: 1474 - DNA, 27 bp, Zea mays
gtgcttcttatttctatgaacaaacca

SEQ ID NO: 1475 - DNA, 15 bp, Zea mays
catgctgtcctaatt

SEQ ID NO: 1476 - DNA, 14 bp, Zea mays
atgctgccctaatt

SEQ ID NO: 1477 - DNA, 21 bp, Zea mays
tctcctcgggaagccatactt

SEQ ID NO: 1478 - DNA, 21 bp, Zea mays
cggctggttgacatgagactt

SEQ ID NO: 1479 - DNA, 14 bp, Zea mays
acatgcattctctg

SEQ ID NO: 1480 - DNA, 14 bp, Zea mays
catgcatcctctgc

SEQ ID NO: 1481 - DNA, 22 bp, Zea mays
cattggattggatgccactgta

SEQ ID NO: 1482 - DNA, 25 bp, Zea mays
ccatcttttaaaatccagtcaccaa

SEQ ID NO: 1483 - DNA, 16 bp, Zea mays
agcatctgatttgatc

SEQ ID NO: 1484 - DNA, 14 bp, Zea mays
agcatccgatttga

SEQ ID NO: 1485 - DNA, 26 bp, Zea mays
ggtcgattattttaccaacactcttg

SEQ ID NO: 1486 - DNA, 24 bp, Zea mays
cgacgaaccttttcttttatggaa

SEQ ID NO: 1487 - DNA, 13 bp, Zea mays
cgatggactttcc

SEQ ID NO: 1488 - DNA, 13 bp, Zea mays
agcgatgaacttt

SEQ ID NO: 1489 - DNA, 25 bp, Zea mays
gcctgcagtttctttggtagacata

SEQ ID NO: 1490 - DNA, 33 bp, Zea mays
tcacagtataactcaacataaagattagcatct

SEQ ID NO: 1491 - DNA, 16 bp, Zea mays
aaggtggttagttctt

SEQ ID NO: 1492 - DNA, 17 bp, Zea mays
catgaaggtgattagtt

SEQ ID NO: 1493 - DNA, 26 bp, Zea mays
ggtcttgtacacatcatgtccgtagt

SEQ ID NO: 1494 - DNA, 19 bp, Zea mays
gcccagcatggtattgcaa

SEQ ID NO: 1495 - DNA, 14 bp, Zea mays
agctgtcgatctta

SEQ ID NO: 1496 - DNA, 14 bp, Zea mays
agctgtccatctta

SEQ ID NO: 1497 - DNA, 21 bp, Zea mays
atggtctggaccgttgcataa

SEQ ID NO: 1498 - DNA, 21 bp, Zea mays
cagccggagcagttaattgtg

SEQ ID NO: 1499 - DNA, 14 bp, Zea mays
aggcgtagattatc

SEQ ID NO: 1500 - DNA, 15 bp, Zea mays
aggcgtaggttatct

SEQ ID NO: 1501 - DNA, 22 bp, Zea mays
ggaatgcgcataatctcgaact

SEQ ID NO: 1502 - DNA, 24 bp, Zea mays
gggattcaatatctgccatcaaat

SEQ ID NO: 1503 - DNA, 16 bp, Zea mays
tgtgccttattaaatc

SEQ ID NO: 1504 - DNA, 15 bp, Zea mays
tgccttagtaaatct

SEQ ID NO: 1505 - DNA, 19 bp, Zea mays
cggtgtagggcacaatgct

SEQ ID NO: 1506 - DNA, 22 bp, Zea mays
catgaacgaggaaacggaaaag

SEQ ID NO: 1507 - DNA, 14 bp, Zea mays
ctgggaaccccttc

SEQ ID NO: 1508 - DNA, 15 bp, Zea mays
tgggaaacccttcac

SEQ ID NO: 1509 - DNA, 26 bp, Zea mays
gtcagaatcatcactacaggcacttc

SEQ ID NO: 1510 - DNA, 27 bp, Zea mays
caaacagttagttgccttgtattatcg

SEQ ID NO: 1511 - DNA, 16 bp, Zea mays
cgagtactgaatgttt

SEQ ID NO: 1512 - DNA, 16 bp, Zea mays
cgagtactgaacgttt

SEQ ID NO: 1513 - DNA, 20 bp, Zea mays
cggcgtgtactgctccttgt

SEQ ID NO: 1514 - DNA, 18 bp, Zea mays
ccgaaggcgttcgagaag

SEQ ID NO: 1515 - DNA, 14 bp, Zea mays
ttgcccatcgcctt

SEQ ID NO: 1516 - DNA, 13 bp, Zea mays
cccatcaccttcc

SEQ ID NO: 1517 - DNA, 20 bp, Zea mays
aggccgtgatcatggagatt

SEQ ID NO: 1518 - DNA, 34 bp, Zea mays
cagctagtaagaatgtataaaaagttattgttca

SEQ ID NO: 1519 - DNA, 14 bp, Zea mays
ctcgtgaaatattg

SEQ ID NO: 1520 - DNA, 14 bp, Zea mays
actcgtggaatatt

SEQ ID NO: 1521 - DNA, 28 bp, Zea mays
tttctgatatgctagattcactggattc

SEQ ID NO: 1522 - DNA, 23 bp, Zea mays
aagcttcatcaagtgctggattg

SEQ ID NO: 1523 - DNA, 14 bp, Zea mays
aatgctgccctcct

SEQ ID NO: 1524 - DNA, 13 bp, Zea mays
aaatgccgccctc

SEQ ID NO: 1525 - DNA, 23 bp, Zea mays
cttaagaatgaagcgcagctcac

SEQ ID NO: 1526 - DNA, 19 bp, Zea mays
ggatccagtcgacgacggt

SEQ ID NO: 1527 - DNA, 15 bp, Zea mays
cgacggttacctgga

SEQ ID NO: 1528 - DNA, 14 bp, Zea mays
cgacgggtacctgg

SEQ ID NO: 1529 - DNA, 25 bp, Zea mays
cccttccattctcttgaaattttct

SEQ ID NO: 1530 - DNA, 26 bp, Zea mays
cattaatttgtagctggactggacat

SEQ ID NO: 1531 - DNA, 13 bp, Zea mays
cccttgaactttc

SEQ ID NO: 1532 - DNA, 13 bp, Zea mays
cccttgaacttcc

SEQ ID NO: 1533 - DNA, 24 bp, Zea mays
ggcggagtcgaacttagaacataa

SEQ ID NO: 1534 - DNA, 25 bp, Zea mays
gtgccacacgaaggttagacttatt

SEQ ID NO: 1535 - DNA, 15 bp, Zea mays
tccgaatagcatttc

SEQ ID NO: 1536 - DNA, 14 bp, Zea mays
cgaattgcatttct

SEQ ID NO: 1537 - DNA, 22 bp, Zea mays
acatcggtggtgagatttctga

SEQ ID NO: 1538 - DNA, 18 bp, Zea mays
cggccgtcaaggatctga

SEQ ID NO: 1539 - DNA, 14 bp, Zea mays
ctgcactgcacacc

SEQ ID NO: 1540 - DNA, 14 bp, Zea mays
cctgcatgcacacc

SEQ ID NO: 1541 - DNA, 25 bp, Zea mays
gcatgatcaatcataaactcaccaa

SEQ ID NO: 1542 - DNA, 20 bp, Zea mays
cagggaagcgtggattcaga

SEQ ID NO: 1543 - DNA, 15 bp, Zea mays
aggtttccgcatcaa

SEQ ID NO: 1544 - DNA, 15 bp, Zea mays
aggtttccacatcaa

SEQ ID NO: 1545 - DNA, 21 bp, Zea mays
tccgtgtaggcttccccttaa

SEQ ID NO: 1546 - DNA, 23 bp, Zea mays
cgaagtagcacagagcacatgaa

SEQ ID NO: 1547 - DNA, 14 bp, Zea mays
caccttcttgcccc

SEQ ID NO: 1548 - DNA, 14 bp, Zea mays
accttgccccggga

SEQ ID NO: 1549 - DNA, 20 bp, Zea mays
ggcacgttgatcatgtcgtt

SEQ ID NO: 1550 - DNA, 23 bp, Zea mays
taacggctgttcactcatcattg

SEQ ID NO: 1551 - DNA, 15 bp, Zea mays
aactgctgacatcca

SEQ ID NO: 1552 - DNA, 13 bp, Zea mays
actgccgacatcc

SEQ ID NO: 1553 - DNA, 23 bp, Zea mays
ttgtgttcaagcttgtcctcctt

SEQ ID NO: 1554 - DNA, 20 bp, Zea mays
tcccagcggtatgcagagat

SEQ ID NO: 1555 - DNA, 15 bp, Zea mays
tgtttctgcatttct

SEQ ID NO: 1556 - DNA, 14 bp, Zea mays
tgtttccgcatttc

SEQ ID NO: 1557 - DNA, 18 bp, Zea mays
tggaacggagacggacca

SEQ ID NO: 1558 - DNA, 21 bp, Zea mays
gagaagatgagcacgcaggaa

SEQ ID NO: 1559 - DNA, 15 bp, Zea mays
ctgtaagatatcccc

SEQ ID NO: 1560 - DNA, 15 bp, Zea mays
ctgtaagatattccc

SEQ ID NO: 1561 - DNA, 20 bp, Zea mays
ttgcgccaacctttctcttc

SEQ ID NO: 1562 - DNA, 20 bp, Zea mays
ttcgtggtgcggtgtgtact

SEQ ID NO: 1563 - DNA, 20 bp, Zea mays
actacgtactatagcaagaa

SEQ ID NO: 1564 - DNA, 15 bp, Zea mays
cgtactagcaagaaa

SEQ ID NO: 1565 - DNA, 24 bp, Zea mays
accagttcatctgtatgtcggaaa

SEQ ID NO: 1566 - DNA, 20 bp, Zea mays
tggatgtcccttgcacgttt

SEQ ID NO: 1567 - DNA, 13 bp, Zea mays
aacggctgaaggc

SEQ ID NO: 1568 - DNA, 15 bp, Zea mays
aaacggatgaaggca

SEQ ID NO: 1569 - DNA, 19 bp, Zea mays
ccacatcccggcttctctt

SEQ ID NO: 1570 - DNA, 22 bp, Zea mays
cccagatctgagttgtgtgcat

SEQ ID NO: 1571 - DNA, 15 bp, Zea mays
accttaccgatctgg

SEQ ID NO: 1572 - DNA, 15 bp, Zea mays
accttaccaatctgg

SEQ ID NO: 1573 - DNA, 22 bp, Zea mays
tttgtctcttcagggtcatgca

SEQ ID NO: 1574 - DNA, 24 bp, Zea mays
ccaccaaacatgctcagattctac

SEQ ID NO: 1575 - DNA, 13 bp, Zea mays
atcgccaagcaac

SEQ ID NO: 1576 - DNA, 13 bp, Zea mays
atcgccaaccaac

SEQ ID NO: 1577 - DNA, 26 bp, Zea mays
aggacacaatgctaatactgaaccaa

SEQ ID NO: 1578 - DNA, 27 bp, Zea mays
ggaactataattgttgtcactgccatt

SEQ ID NO: 1579 - DNA, 13 bp, Zea mays
cagcaaaatcctg

SEQ ID NO: 1580 - DNA, 13 bp, Zea mays
tcagcagaatcct

SEQ ID NO: 1581 - DNA, 25 bp, Zea mays
caagcaacagctagcaacataaaaa

SEQ ID NO: 1582 - DNA, 22 bp, Zea mays
ccacctgctccaaccacttaat

SEQ ID NO: 1583 - DNA, 14 bp, Zea mays
ttgggtcgaggaac

SEQ ID NO: 1584 - DNA, 13 bp, Zea mays
ttgggccgaggaa

SEQ ID NO: 1585 - DNA, 22 bp, Zea mays
agaagagcagcagctggatagc

SEQ ID NO: 1586 - DNA, 20 bp, Zea mays
aggatcgtttcgccgataga

SEQ ID NO: 1587 - DNA, 17 bp, Zea mays
atagaactgcttttttc

SEQ ID NO: 1588 - DNA, 16 bp, Zea mays
agaactgcttttctct

SEQ ID NO: 1589 - DNA, 22 bp, Zea mays
ggcaatggcactacagtaagca

SEQ ID NO: 1590 - DNA, 20 bp, Zea mays
gcttgccccactgtgaaact

SEQ ID NO: 1591 - DNA, 13 bp, Zea mays
tccccacaattgg

SEQ ID NO: 1592 - DNA, 13 bp, Zea mays
ccccaccattggt

SEQ ID NO: 1593 - DNA, 27 bp, Zea mays
tgggccttatcctaaagaaataaaaga

SEQ ID NO: 1594 - DNA, 29 bp, Zea mays
ctccattgttctctatctattaggacaga

SEQ ID NO: 1595 - DNA, 19 bp, Zea mays
ctctacttaacattttacc

SEQ ID NO: 1596 - DNA, 17 bp, Zea mays
ctacttgacattttacc

SEQ ID NO: 1597 - DNA, 22 bp, Zea mays
tccagttcttcagcgtgtcaaa

SEQ ID NO: 1598 - DNA, 22 bp, Zea mays
agtttaccagcttgccaatgct

SEQ ID NO: 1599 - DNA, 13 bp, Zea mays
tctggtgcggtcc

SEQ ID NO: 1600 - DNA, 14 bp, Zea mays
tctggtgcggtacc

SEQ ID NO: 1601 - DNA, 20 bp, Zea mays
gggcctcattcgctaatcac

SEQ ID NO: 1602 - DNA, 26 bp, Zea mays
cagcatctaccatagtgcattaatgg

SEQ ID NO: 1603 - DNA, 15 bp, Zea mays
agggacgtataatct

SEQ ID NO: 1604 - DNA, 15 bp, Zea mays
cagggatgtataatc

SEQ ID NO: 1605 - DNA, 24 bp, Zea mays
cctcttgatcctctgaacctgcta

SEQ ID NO: 1606 - DNA, 24 bp, Zea mays
gaatgggcagtcttatgtgaaaaa

SEQ ID NO: 1607 - DNA, 15 bp, Zea mays
cgaatccacgtcttg

SEQ ID NO: 1608 - DNA, 14 bp, Zea mays
cgaatccacatctt

SEQ ID NO: 1609 - DNA, 18 bp, Zea mays
gcacgggcaacaacatca

SEQ ID NO: 1610 - DNA, 25 bp, Zea mays
ggatagaatatgagacgggttgatc

SEQ ID NO: 1611 - DNA, 16 bp, Zea mays
cctttttgctcccgct

SEQ ID NO: 1612 - DNA, 13 bp, Zea mays
ccttttcgctccc

SEQ ID NO: 1613 - DNA, 24 bp, Zea mays
tgttcttcggggtgttactatcct

SEQ ID NO: 1614 - DNA, 24 bp, Zea mays
aaccgaaccctgaataaagaaggt

SEQ ID NO: 1615 - DNA, 16 bp, Zea mays
ttgctttgtaattttt

SEQ ID NO: 1616 - DNA, 14 bp, Zea mays
tgcttcgtaatttt

SEQ ID NO: 1617 - DNA, 23 bp, Zea mays
ctgaatccagttctcgtctttgg

SEQ ID NO: 1618 - DNA, 21 bp, Zea mays
atgctttgcactcaggtttgg

SEQ ID NO: 1619 - DNA, 19 bp, Zea mays
tctaggttaataaatgtcc

SEQ ID NO: 1620 - DNA, 17 bp, Zea mays
ctaggtcaataaatgtc

SEQ ID NO: 1621 - DNA, 27 bp, Zea mays
tggtttgcagcttattgattactatga

SEQ ID NO: 1622 - DNA, 21 bp, Zea mays
gcagcgtcaatgcatccttat

SEQ ID NO: 1623 - DNA, 14 bp, Zea mays
cttcgctataaccc

SEQ ID NO: 1624 - DNA, 13 bp, Zea mays
ttcgctacaaccc

SEQ ID NO: 1625 - DNA, 16 bp, Zea mays
ccgacgcgagccaatg

SEQ ID NO: 1626 - DNA, 17 bp, Zea mays
cggtggcggtggagaat

SEQ ID NO: 1627 - DNA, 14 bp, Zea mays
tgctccttgttctc

SEQ ID NO: 1628 - DNA, 14 bp, Zea mays
tgctccttgatctc

SEQ ID NO: 1629 - DNA, 25 bp, Zea mays
agcgacgtctctaaaggctatctct

SEQ ID NO: 1630 - DNA, 22 bp, Zea mays
agaacagtcttggctgtgtcga

SEQ ID NO: 1631 - DNA, 17 bp, Zea mays
ctccctatagcagtagc

SEQ ID NO: 1632 - DNA, 16 bp, Zea mays
tccctagcagtagcag

SEQ ID NO: 1633 - DNA, 24 bp, Zea mays
caattgatggtggccttattacac

SEQ ID NO: 1634 - DNA, 20 bp, Zea mays
actgcgaattgaagccgaat

SEQ ID NO: 1635 - DNA, 16 bp, Zea mays
aaggtacgtacaatct

SEQ ID NO: 1636 - DNA, 14 bp, Zea mays
aggtacgcacaatc

SEQ ID NO: 1637 - DNA, 24 bp, Zea mays
cgctgatagttagaggcctctttc

SEQ ID NO: 1638 - DNA, 27 bp, Zea mays
aagacttcagttaacttactggatgcc

SEQ ID NO: 1639 - DNA, 13 bp, Zea mays
cttgctgatcctc

SEQ ID NO: 1640 - DNA, 13 bp, Zea mays
cttgcagatcctc

SEQ ID NO: 1641 - DNA, 24 bp, Zea mays
atattgcattcccatcagatgaga

SEQ ID NO: 1642 - DNA, 26 bp, Zea mays
tgcatggattctatttctgctaacat

SEQ ID NO: 1643 - DNA, 16 bp, Zea mays
aagtgcacaaatatat

SEQ ID NO: 1644 - DNA, 16 bp, Zea mays
caataagtgcgcaaat

SEQ ID NO: 1645 - DNA, 19 bp, Zea mays
ccagctccagctgctatgg

SEQ ID NO: 1646 - DNA, 27 bp, Zea mays
aacagacatgattctgaatcagcatat

SEQ ID NO: 1647 - DNA, 16 bp, Zea mays
cttcatagccttcttt

SEQ ID NO: 1648 - DNA, 16 bp, Zea mays
cttcatagcattcttt

SEQ ID NO: 1649 - DNA, 21 bp, Zea mays
gcgtgatatgcaagtgcaaca

SEQ ID NO: 1650 - DNA, 25 bp, Zea mays
cctgcttgtacaaatgaacagagaa

SEQ ID NO: 1651 - DNA, 20 bp, Zea mays
aatatatagctgtcatcaat

SEQ ID NO: 1652 - DNA, 16 bp, Zea mays
agctgttatcaatatc

SEQ ID NO: 1653 - DNA, 20 bp, Zea mays
cgaggtagcacaggcagttg

SEQ ID NO: 1654 - DNA, 20 bp, Zea mays
ccctgcttggaatggacatt

SEQ ID NO: 1655 - DNA, 17 bp, Zea mays
atggagtagtttggacc

SEQ ID NO: 1656 - DNA, 16 bp, Zea mays
agatggagtaatttgg

SEQ ID NO: 1657 - DNA, 25 bp, Zea mays
gcttcaagaaaagagcagagtgttg

SEQ ID NO: 1658 - DNA, 21 bp, Zea mays
tgtcgctaatagccagcagct

SEQ ID NO: 1659 - DNA, 17 bp, Zea mays
aaagtagctaagaaaaa

SEQ ID NO: 1660 - DNA, 16 bp, Zea mays
aaagtagccaagaaaa

SEQ ID NO: 1661 - DNA, 23 bp, Zea mays
gagccgatgcattaaagaaactg

SEQ ID NO: 1662 - DNA, 28 bp, Zea mays
gatgagtagatgactatgatgcctctgt

SEQ ID NO: 1663 - DNA, 15 bp, Zea mays
ctgctgtcatgggaa

SEQ ID NO: 1664 - DNA, 15 bp, Zea mays
ctgctctcatgggaa

SEQ ID NO: 1665 - DNA, 23 bp, Zea mays
tccctcttttgtcaatcgtgttt

SEQ ID NO: 1666 - DNA, 21 bp, Zea mays
ggtgatccggacatcttcctt

SEQ ID NO: 1667 - DNA, 16 bp, Zea mays
cctctcctaatcagac

SEQ ID NO: 1668 - DNA, 16 bp, Zea mays
ctctcctgatcagacc

SEQ ID NO: 1669 - DNA, 20 bp, Zea mays
gcttagcgtggtcgttccaa

SEQ ID NO: 1670 - DNA, 25 bp, Zea mays
gctaaaaggccaaatatccacaact

SEQ ID NO: 1671 - DNA, 14 bp, Zea mays
aacgaccatattcc

SEQ ID NO: 1672 - DNA, 16 bp, Zea mays
aagaacgatcatattc

SEQ ID NO: 1673 - DNA, 24 bp, Zea mays
caggctaatctctgacaccaaacc

SEQ ID NO: 1674 - DNA, 23 bp, Zea mays
cattcacccatctgctacgattt

SEQ ID NO: 1675 - DNA, 14 bp, Zea mays
actgcgacctgttc

SEQ ID NO: 1676 - DNA, 16 bp, Zea mays
ttcactgcaacctgtt

SEQ ID NO: 1677 - DNA, 24 bp, Zea mays
tcctgatcccttgatacactgtca

SEQ ID NO: 1678 - DNA, 23 bp, Zea mays
ccgacagatgttactcgtcaggt

SEQ ID NO: 1679 - DNA, 15 bp, Zea mays
tggtgttgagattgt

SEQ ID NO: 1680 - DNA, 15 bp, Zea mays
tctggtgtcgagatt

SEQ ID NO: 1681 - DNA, 22 bp, Zea mays
cgacccaaacttcaagaagctt

SEQ ID NO: 1682 - DNA, 23 bp, Zea mays
cagcgtcccatcgtagtctaaga

SEQ ID NO: 1683 - DNA, 15 bp, Zea mays
tggtcttggcctacc

SEQ ID NO: 1684 - DNA, 14 bp, Zea mays
tggtctcggcctac

SEQ ID NO: 1685 - DNA, 21 bp, Zea mays
ggccaacctgtcacaaaacct

SEQ ID NO: 1686 - DNA, 22 bp, Zea mays
gcccagatagcatgttgttgtc

SEQ ID NO: 1687 - DNA, 14 bp, Zea mays
tccttggctcaaac

SEQ ID NO: 1688 - DNA, 16 bp, Zea mays
tgtccttagctcaaac

SEQ ID NO: 1689 - DNA, 18 bp, Zea mays
agccaccccgacctgtct

SEQ ID NO: 1690 - DNA, 18 bp, Zea mays
tggcaggcagcagctttt

SEQ ID NO: 1691 - DNA, 14 bp, Zea mays
ctgagctgaaataa

SEQ ID NO: 1692 - DNA, 14 bp, Zea mays
ctgaggtgaaataa

SEQ ID NO: 1693 - DNA, 22 bp, Zea mays
ttgagcagagaactgcaaccaa

SEQ ID NO: 1694 - DNA, 21 bp, Zea mays
gccttttgatttttgcaggtt

SEQ ID NO: 1695 - DNA, 18 bp, Zea mays
tgcttattacaaacatct

SEQ ID NO: 1696 - DNA, 16 bp, Zea mays
attacacacatctctc

SEQ ID NO: 1697 - DNA, 25 bp, Zea mays
cttactcgcatatgagatcctgatg

SEQ ID NO: 1698 - DNA, 19 bp, Zea mays
caagcaaaggcgccagttt

SEQ ID NO: 1699 - DNA, 15 bp, Zea mays
cttgagaaggattcg

SEQ ID NO: 1700 - DNA, 16 bp, Zea mays
tgagaacgattcgaag

SEQ ID NO: 1701 - DNA, 17 bp, Zea mays
gtcggcttggccaagtg

SEQ ID NO: 1702 - DNA, 16 bp, Zea mays
ccgcgcaccgttgaat

SEQ ID NO: 1703 - DNA, 14 bp, Zea mays
agaacgtgaaagct

SEQ ID NO: 1704 - DNA, 15 bp, Zea mays
agaacatgaaagctg

SEQ ID NO: 1705 - DNA, 19 bp, Zea mays
gctcccatccgtcctcctt

SEQ ID NO: 1706 - DNA, 25 bp, Zea mays
cacaagataagaactgctctgcaaa

SEQ ID NO: 1707 - DNA, 15 bp, Zea mays
atcacgttgaattca

SEQ ID NO: 1708 - DNA, 16 bp, Zea mays
catcacattgaattca

SEQ ID NO: 1709 - DNA, 23 bp, Zea mays
catttgaagctgatcggacaatc

SEQ ID NO: 1710 - DNA, 18 bp, Zea mays
acatgctcgggcaaccat

SEQ ID NO: 1711 - DNA, 15 bp, Zea mays
tgtcacatgtctctc

SEQ ID NO: 1712 - DNA, 15 bp, Zea mays
ttgtcacgtctctct

SEQ ID NO: 1713 - DNA, 20 bp, Zea mays
gtttggctttttggcaccat

SEQ ID NO: 1714 - DNA, 20 bp, Zea mays
agccagagcgtcaccattct

SEQ ID NO: 1715 - DNA, 16 bp, Zea mays
tgctggtctatgatac

SEQ ID NO: 1716 - DNA, 16 bp, Zea mays
tgctggtctataatac

SEQ ID NO: 1717 - DNA, 24 bp, Zea mays
acccaccatcatcatccactttat

SEQ ID NO: 1718 - DNA, 24 bp, Zea mays
ttgcagccttcatcttcaataatg

SEQ ID NO: 1719 - DNA, 17 bp, Zea mays
ctagaagttcctcttgc

SEQ ID NO: 1720 - DNA, 16 bp, Zea mays
agtgtactagaacttc

SEQ ID NO: 1721 - DNA, 25 bp, Zea mays
gggaaatggtgataaaacctcaaag

SEQ ID NO: 1722 - DNA, 27 bp, Zea mays
gtatgtgttagtgagaaccagcagttt

SEQ ID NO: 1723 - DNA, 14 bp, Zea mays
taggcagcaaactg

SEQ ID NO: 1724 - DNA, 16 bp, Zea mays
aggcagaactgtttta

SEQ ID NO: 1725 - DNA, 22 bp, Zea mays
ggtcatggtctatctgggcatt

SEQ ID NO: 1726 - DNA, 25 bp, Zea mays
ggtggattctctctaacctgtgaac

SEQ ID NO: 1727 - DNA, 16 bp, Zea mays
ccttgactcagtactt

SEQ ID NO: 1728 - DNA, 17 bp, Zea mays
ccttgattcagtacttc

SEQ ID NO: 1729 - DNA, 24 bp, Zea mays
gggaaaaacaattacctgcactgt

SEQ ID NO: 1730 - DNA, 20 bp, Zea mays
tgccaaccgggatatggata

SEQ ID NO: 1731 - DNA, 15 bp, Zea mays
ttgctgtcggtaatt

SEQ ID NO: 1732 - DNA, 15 bp, Zea mays
cagcttgctatcggt

SEQ ID NO: 1733 - DNA, 29 bp, Zea mays
ccatggagagagaatatactgttcttacc

SEQ ID NO: 1734 - DNA, 21 bp, Zea mays
aagtgggccatagcctgaaac

SEQ ID NO: 1735 - DNA, 16 bp, Zea mays
tcctacggttgcacaa

SEQ ID NO: 1736 - DNA, 18 bp, Zea mays
agtcctacagttgcacaa

SEQ ID NO: 1737 - DNA, 22 bp, Zea mays
tccccagatccagttttgattc

SEQ ID NO: 1738 - DNA, 20 bp, Zea mays
ggaaccagcatgttgccatt

SEQ ID NO: 1739 - DNA, 15 bp, Zea mays
ctccatagaaaaatt

SEQ ID NO: 1740 - DNA, 13 bp, Zea mays
tccatcgaaaaat

SEQ ID NO: 1741 - DNA, 28 bp, Zea mays
caaacaaatcagaggactgtaaacaaat

SEQ ID NO: 1742 - DNA, 26 bp, Zea mays
aatgtacgtcctcattctttgtcatc

SEQ ID NO: 1743 - DNA, 17 bp, Zea mays
tgtttcaccattagctt

SEQ ID NO: 1744 - DNA, 21 bp, Zea mays
tttgtttcactattagcttta

SEQ ID NO: 1745 - DNA, 22 bp, Zea mays
ccctacactgcttctcattcga

SEQ ID NO: 1746 - DNA, 30 bp, Zea mays
ttgttttgtttctaaagattcacatttctt

SEQ ID NO: 1747 - DNA, 15 bp, Zea mays
tgattggtcttttcc

SEQ ID NO: 1748 - DNA, 15 bp, Zea mays
cgtgattgatctttt

SEQ ID NO: 1749 - DNA, 19 bp, Zea mays
atgcaacgcggaagaactg

SEQ ID NO: 1750 - DNA, 19 bp, Zea mays
ccaagtacgacggctccaa

SEQ ID NO: 1751 - DNA, 16 bp, Zea mays
ccatgataacgggtct

SEQ ID NO: 1752 - DNA, 14 bp, Zea mays
ccatgacaacgggt

SEQ ID NO: 1753 - DNA, 17 bp, Zea mays
gccggcctgctcaagaa

SEQ ID NO: 1754 - DNA, 20 bp, Zea mays
gacgcagacgctcctaccat

SEQ ID NO: 1755 - DNA, 15 bp, Zea mays
ctctctctcgactcc

SEQ ID NO: 1756 - DNA, 15 bp, Zea mays
agctctccctcgact

SEQ ID NO: 1757 - DNA, 23 bp, Zea mays
aaatctctcggcctccataaatc

SEQ ID NO: 1758 - DNA, 24 bp, Zea mays
gggcaaggtaatgctaatgctaga

SEQ ID NO: 1759 - DNA, 14 bp, Zea mays
acccatcgcaagca

SEQ ID NO: 1760 - DNA, 14 bp, Zea mays
cccatcacaagcat

SEQ ID NO: 1761 - DNA, 27 bp, Zea mays
actaaatgcattatcagcaacatcaat

SEQ ID NO: 1762 - DNA, 22 bp, Zea mays
ggagtattcctgctggcttgtg

SEQ ID NO: 1763 - DNA, 16 bp, Zea mays
tatcacagcattaggc

SEQ ID NO: 1764 - DNA, 18 bp, Zea mays
atcacagaattaggcaat

SEQ ID NO: 1765 - DNA, 22 bp, Zea mays
cccagtcaatcgcaatcagatt

SEQ ID NO: 1766 - DNA, 30 bp, Zea mays
cagataactagatagtgtggagtcgtaaca

SEQ ID NO: 1767 - DNA, 14 bp, Zea mays
ctgatcgccttttg

SEQ ID NO: 1768 - DNA, 15 bp, Zea mays
actgatcgcctttga

SEQ ID NO: 1769 - DNA, 25 bp, Zea mays
ttgtggaacaattttgtcttcattg

SEQ ID NO: 1770 - DNA, 23 bp, Zea mays
aacaacttgggcatggaataaag

SEQ ID NO: 1771 - DNA, 15 bp, Zea mays
acgcttacaacatct

SEQ ID NO: 1772 - DNA, 15 bp, Zea mays
cgcttacagcatcta

SEQ ID NO: 1773 - DNA, 19 bp, Zea mays
ccgccactgcatcattttc

SEQ ID NO: 1774 - DNA, 23 bp, Zea mays
tgtttgttctccagggatctgtt

SEQ ID NO: 1775 - DNA, 21 bp, Zea mays
tacataattttttgcattgtc

SEQ ID NO: 1776 - DNA, 21 bp, Zea mays
tacataaatttttgcattgtc

SEQ ID NO: 1777 - DNA, 25 bp, Zea mays
aaatcagggaagtttgcaatgtatg

SEQ ID NO: 1778 - DNA, 20 bp, Zea mays
tttgggttgctcatggacaa

SEQ ID NO: 1779 - DNA, 17 bp, Zea mays
tgctacaatgctatacc

SEQ ID NO: 1780 - DNA, 16 bp, Zea mays
tgctacactgctatac

SEQ ID NO: 1781 - DNA, 28 bp, Zea mays
agttacctggacatagatatcgaaaacc

SEQ ID NO: 1782 - DNA, 24 bp, Zea mays
ttgactttccagacatgcagtctt

SEQ ID NO: 1783 - DNA, 13 bp, Zea mays
tccctcggcttct

SEQ ID NO: 1784 - DNA, 13 bp, Zea mays
tccctcagcttct

SEQ ID NO: 1785 - DNA, 26 bp, Zea mays
gatcaagcattaggattgctgattac

SEQ ID NO: 1786 - DNA, 22 bp, Zea mays
gcatctggtccaaactgttcct

SEQ ID NO: 1787 - DNA, 13 bp, Zea mays
ccaaaacaagccc

SEQ ID NO: 1788 - DNA, 17 bp, Zea mays
ccaaaataagcccctca

SEQ ID NO: 1789 - DNA, 23 bp, Zea mays
ggtaccgtggcatattgaaggta

SEQ ID NO: 1790 - DNA, 26 bp, Zea mays
cagctaacacaaagggactgtattgt

SEQ ID NO: 1791 - DNA, 16 bp, Zea mays
ctatcatgagaatcct

SEQ ID NO: 1792 - DNA, 15 bp, Zea mays
tatcacgagaatcct

SEQ ID NO: 1793 - DNA, 21 bp, Zea mays
actcggaacggctgctatgta

SEQ ID NO: 1794 - DNA, 22 bp, Zea mays
cgcttcataacgtcgcaacata

SEQ ID NO: 1795 - DNA, 16 bp, Zea mays
ccatcacgtacgtacg

SEQ ID NO: 1796 - DNA, 15 bp, Zea mays
acgtacgtcgaatca

SEQ ID NO: 1797 - DNA, 19 bp, Zea mays
tcgccggactccagtagct

SEQ ID NO: 1798 - DNA, 27 bp, Zea mays
tggtacttaactgactggattcacatg

SEQ ID NO: 1799 - DNA, 14 bp, Zea mays
cacctgcccattgg

SEQ ID NO: 1800 - DNA, 14 bp, Zea mays
ccacctgcacattg

SEQ ID NO: 1801 - DNA, 25 bp, Zea mays
gtcccactagagggtgaaagatttt

SEQ ID NO: 1802 - DNA, 25 bp, Zea mays
gctgcaactactcttgaaggttctc

SEQ ID NO: 1803 - DNA, 16 bp, Zea mays
ctgtatgtgtcacccc

SEQ ID NO: 1804 - DNA, 14 bp, Zea mays
tgtatgcgtcaccc

SEQ ID NO: 1805 - DNA, 16 bp, Zea mays
cgcaggcgcctgagaa

SEQ ID NO: 1806 - DNA, 22 bp, Zea mays
cttctcctcctccacgctactc

SEQ ID NO: 1807 - DNA, 15 bp, Zea mays
aaaaccatcccgccc

SEQ ID NO: 1808 - DNA, 15 bp, Zea mays
caaaaccctcccgcc

SEQ ID NO: 1809 - DNA, 23 bp, Zea mays
agctattggttttgccattgaaa

SEQ ID NO: 1810 - DNA, 22 bp, Zea mays
ccttggacccctacttcacagt

SEQ ID NO: 1811 - DNA, 13 bp, Zea mays
acaccggtcaatc

SEQ ID NO: 1812 - DNA, 13 bp, Zea mays
caccgatcaatcc

SEQ ID NO: 1813 - DNA, 20 bp, Zea mays
gccacccacctctttttcaa

SEQ ID NO: 1814 - DNA, 23 bp, Zea mays
caaggcgtaaaacaacacctaga

SEQ ID NO: 1815 - DNA, 14 bp, Zea mays
tacggttcgatccc

SEQ ID NO: 1816 - DNA, 13 bp, Zea mays
cggttcgatcacc

SEQ ID NO: 1817 - DNA, 23 bp, Zea mays
ccagccgttcattaagcttacaa

SEQ ID NO: 1818 - DNA, 19 bp, Zea mays
tgccaggattgtggatgct

SEQ ID NO: 1819 - DNA, 17 bp, Zea mays
catcatgaacatcaaaa

SEQ ID NO: 1820 - DNA, 17 bp, Zea mays
catcatgaacataaaaa

SEQ ID NO: 1821 - DNA, 20 bp, Zea mays
acatgtgccatttcgatgga

SEQ ID NO: 1822 - DNA, 29 bp, Zea mays
tctacgaagttgtaataacaaattttgca

SEQ ID NO: 1823 - DNA, 15 bp, Zea mays
aacatacaaatttcc

SEQ ID NO: 1824 - DNA, 16 bp, Zea mays
aaacatacaaacttcc

SEQ ID NO: 1825 - DNA, 25 bp, Zea mays
atccatgtgctcatttgagattttt

SEQ ID NO: 1826 - DNA, 24 bp, Zea mays
catgagtcgtacattgggaatcac

SEQ ID NO: 1827 - DNA, 19 bp, Zea mays
acgaatacaaaataaataa

SEQ ID NO: 1828 - DNA, 19 bp, Zea mays
acttctatacgaataaaaa

SEQ ID NO: 1829 - DNA, 18 bp, Zea mays
ccgcttcgcctcacaatc

SEQ ID NO: 1830 - DNA, 20 bp, Zea mays
gccgacgttcacggtgtagt

SEQ ID NO: 1831 - DNA, 14 bp, Zea mays
tggcttcttttgcg

SEQ ID NO: 1832 - DNA, 14 bp, Zea mays
tggcttctcttgcg

SEQ ID NO: 1833 - DNA, 16 bp, Zea mays
gcaggcgcgcgactac

SEQ ID NO: 1834 - DNA, 22 bp, Zea mays
cactcacctcgacacctacgaa

SEQ ID NO: 1835 - DNA, 15 bp, Zea mays
aggagggatcagcac

SEQ ID NO: 1836 - DNA, 13 bp, Zea mays
aggaggcatcagc

SEQ ID NO: 1837 - DNA, 28 bp, Zea mays
ggcagattgagaaagcctatctagtatt

SEQ ID NO: 1838 - DNA, 20 bp, Zea mays
cattgcgttccacaggacaa

SEQ ID NO: 1839 - DNA, 16 bp, Zea mays
atgaaacacaagaatg

SEQ ID NO: 1840 - DNA, 16 bp, Zea mays
catgaaacaaaagaat

SEQ ID NO: 1841 - DNA, 24 bp, Zea mays
gatttatgcaatgcttacgtttcg

SEQ ID NO: 1842 - DNA, 20 bp, Zea mays
acctgggacagcaggacatc

SEQ ID NO: 1843 - DNA, 13 bp, Zea mays
ctcctgccctcgc

SEQ ID NO: 1844 - DNA, 15 bp, Zea mays
ctcctaccctcgcca

SEQ ID NO: 1845 - DNA, 21 bp, Zea mays
gaaggcttgcctcggtttatc

SEQ ID NO: 1846 - DNA, 21 bp, Zea mays
gctggaggctcccacactagt

SEQ ID NO: 1847 - DNA, 16 bp, Zea mays
cctttttcccgaccct

SEQ ID NO: 1848 - DNA, 15 bp, Zea mays
cctttttccagaccc

SEQ ID NO: 1849 - DNA, 22 bp, Zea mays
gtgcgcctagtctttcattcct

SEQ ID NO: 1850 - DNA, 19 bp, Zea mays
ggcaaaggcaacacagcaa

SEQ ID NO: 1851 - DNA, 13 bp, Zea mays
accctgcttctgc

SEQ ID NO: 1852 - DNA, 14 bp, Zea mays
cacccttctgctcc

SEQ ID NO: 1853 - DNA, 27 bp, Zea mays
caggtctgtgacattatagatggctta

SEQ ID NO: 1854 - DNA, 25 bp, Zea mays
cgtctcgagttctttattgcagttt

SEQ ID NO: 1855 - DNA, 18 bp, Zea mays
cagtcaagtgtttaaata

SEQ ID NO: 1856 - DNA, 16 bp, Zea mays
cagtcaggtgtttaaa

SEQ ID NO: 1857 - DNA, 22 bp, Zea mays
gcaaggtaaatgaccggtcagt

SEQ ID NO: 1858 - DNA, 19 bp, Zea mays
agcctggagctcccatttg

SEQ ID NO: 1859 - DNA, 14 bp, Zea mays
agcactgaagctta

SEQ ID NO: 1860 - DNA, 15 bp, Zea mays
agcactgaagcatac

SEQ ID NO: 1861 - DNA, 20 bp, Zea mays
cttgccagcacaggtcttga

SEQ ID NO: 1862 - DNA, 26 bp, Zea mays
cgaattctgaccagtatacacattca

SEQ ID NO: 1863 - DNA, 15 bp, Zea mays
cctaacaaaaatggg

SEQ ID NO: 1864 - DNA, 15 bp, Zea mays
ctaaccaaaatgggc

SEQ ID NO: 1865 - DNA, 18 bp, Zea mays
tcctcctgggcgatcctt

SEQ ID NO: 1866 - DNA, 19 bp, Zea mays
gcatgcaacgcaagcaaga

SEQ ID NO: 1867 - DNA, 16 bp, Zea mays
caggttgtggtgaggt

SEQ ID NO: 1868 - DNA, 16 bp, Zea mays
tgcaggttctggtgag

SEQ ID NO: 1869 - DNA, 21 bp, Zea mays
ggcgatagtttccacgtgtgt

SEQ ID NO: 1870 - DNA, 21 bp, Zea mays
gcacacgtcccacaactccta

SEQ ID NO: 1871 - DNA, 14 bp, Zea mays
tacgctgcagccac

SEQ ID NO: 1872 - DNA, 14 bp, Zea mays
cgtacgctgccacg

SEQ ID NO: 1873 - DNA, 17 bp, Zea mays
gctcgccgctggacagt

SEQ ID NO: 1874 - DNA, 15 bp, Zea mays
agcacgccgccaacc

SEQ ID NO: 1875 - DNA, 15 bp, Zea mays
aggaggaccgcgtag

SEQ ID NO: 1876 - DNA, 15 bp, Zea mays
aggaggagcgcgtag

SEQ ID NO: 1877 - DNA, 26 bp, Zea mays
tggtataatactggctgtcattgtca

SEQ ID NO: 1878 - DNA, 23 bp, Zea mays
gggaaaaagcaggataagttggt

SEQ ID NO: 1879 - DNA, 15 bp, Zea mays
agtgcaagcagagaa

SEQ ID NO: 1880 - DNA, 14 bp, Zea mays
tgcaaggagagaac

SEQ ID NO: 1881 - DNA, 21 bp, Zea mays
tggccatttgctcagaatagc

SEQ ID NO: 1882 - DNA, 22 bp, Zea mays
tcgtaatgatgtcgtgcaaacc

SEQ ID NO: 1883 - DNA, 14 bp, Zea mays
tggaacagattttc

SEQ ID NO: 1884 - DNA, 15 bp, Zea mays
tggaacagactttca

SEQ ID NO: 1885 - DNA, 23 bp, Zea mays
gcatttaattttctgtccaacgc

SEQ ID NO: 1886 - DNA, 27 bp, Zea mays
taacattggtggtttggtgctatataa

SEQ ID NO: 1887 - DNA, 14 bp, Zea mays
ttgcacgcataata

SEQ ID NO: 1888 - DNA, 15 bp, Zea mays
ttgcatgcataataa

SEQ ID NO: 1889 - DNA, 25 bp, Zea mays
cgagaacggaggtagtacatgtttg

SEQ ID NO: 1890 - DNA, 25 bp, Zea mays
gccaatctgagctataagtggaagt

SEQ ID NO: 1891 - DNA, 15 bp, Zea mays
tgaggtaccaatttg

SEQ ID NO: 1892 - DNA, 16 bp, Zea mays
tgaggtatcaatttgt

SEQ ID NO: 1893 - DNA, 22 bp, Zea mays
ctgaaccagtgggcaactagct

SEQ ID NO: 1894 - DNA, 24 bp, Zea mays
gctagcgtcagatttcttcttcgt

SEQ ID NO: 1895 - DNA, 15 bp, Zea mays
caggaagagagctac

SEQ ID NO: 1896 - DNA, 16 bp, Zea mays
atcaggaagagctacc

SEQ ID NO: 1897 - DNA, 21 bp, Zea mays
gatgctagaccggtggaaagc

SEQ ID NO: 1898 - DNA, 19 bp, Zea mays
gtagccggagctgcatcag

SEQ ID NO: 1899 - DNA, 14 bp, Zea mays
catccaccgattca

SEQ ID NO: 1900 - DNA, 14 bp, Zea mays
atccaccggttcag

SEQ ID NO: 1901 - DNA, 21 bp, Zea mays
catggctttcctctggatacg

SEQ ID NO: 1902 - DNA, 26 bp, Zea mays
ggaaaaagagaaaaagaattgaagca

SEQ ID NO: 1903 - DNA, 16 bp, Zea mays
tgtgtatggatgcttt

SEQ ID NO: 1904 - DNA, 16 bp, Zea mays
tgtgtatcgatgcttt

SEQ ID NO: 1905 - DNA, 20 bp, Zea mays
catccgcagaacaccttgct

SEQ ID NO: 1906 - DNA, 20 bp, Zea mays
ccactccatgccggtcttta

SEQ ID NO: 1907 - DNA, 15 bp, Zea mays
tgaggttcggcaaga

SEQ ID NO: 1908 - DNA, 16 bp, Zea mays
tgaggttcagcaagaa

SEQ ID NO: 1909 - DNA, 17 bp, Zea mays
cgcctcgtgctgaacga

SEQ ID NO: 1910 - DNA, 19 bp, Zea mays
cgcgaagacgttccagacc

SEQ ID NO: 1911 - DNA, 13 bp, Zea mays
ctgcagcgcctag

SEQ ID NO: 1912 - DNA, 14 bp, Zea mays
ctgcaacgcctagc

SEQ ID NO: 1913 - DNA, 26 bp, Zea mays
cggatatgtacaaggtgtacgtgagt

SEQ ID NO: 1914 - DNA, 25 bp, Zea mays
cagctagatgtttgtttccatagca

SEQ ID NO: 1915 - DNA, 18 bp, Zea mays
actaaagtaaccattttt

SEQ ID NO: 1916 - DNA, 17 bp, Zea mays
tgatgactaaaataacc

SEQ ID NO: 1917 - DNA, 20 bp, Zea mays
gtgaatgcccgtctgcaata

SEQ ID NO: 1918 - DNA, 28 bp, Zea mays
ttgtaatgcctactttttatgtgtgctt

SEQ ID NO: 1919 - DNA, 19 bp, Zea mays
ttttgaacagaattttatg

SEQ ID NO: 1920 - DNA, 17 bp, Zea mays
tgttttgaagagaattt

SEQ ID NO: 1921 - DNA, 23 bp, Zea mays
ccaagcagcaaatctgacgtact

SEQ ID NO: 1922 - DNA, 26 bp, Zea mays
ggttttcgtcagatatgatacgctaa

SEQ ID NO: 1923 - DNA, 15 bp, Zea mays
tgctgttcatacttc

SEQ ID NO: 1924 - DNA, 16 bp, Zea mays
aggtgctgttcataag

SEQ ID NO: 1925 - DNA, 20 bp, Zea mays
cgggcaagggtgacagtaga

SEQ ID NO: 1926 - DNA, 21 bp, Zea mays
gggctcatgaaacccctagac

SEQ ID NO: 1927 - DNA, 13 bp, Zea mays
caaacgcgctcac

SEQ ID NO: 1928 - DNA, 14 bp, Zea mays
cagcaaacacgctc

SEQ ID NO: 1929 - DNA, 20 bp, Zea mays
tggattaaccacggcatcaa

SEQ ID NO: 1930 - DNA, 25 bp, Zea mays
aaaactgaatcactgcaactcaatg

SEQ ID NO: 1931 - DNA, 14 bp, Zea mays
tggcagtgttccag

SEQ ID NO: 1932 - DNA, 15 bp, Zea mays
tggcagtattccagc

SEQ ID NO: 1933 - DNA, 21 bp, Zea mays
ggaggccaggtaccaagaaga

SEQ ID NO: 1934 - DNA, 24 bp, Zea mays
ctttatctggtccatgagctcgta

SEQ ID NO: 1935 - DNA, 16 bp, Zea mays
tctcgacagtgctaag

SEQ ID NO: 1936 - DNA, 14 bp, Zea mays
tcgacggtgctaag

SEQ ID NO: 1937 - DNA, 23 bp, Zea mays
tggagagtgagtgagtgggaatc

SEQ ID NO: 1938 - DNA, 25 bp, Zea mays
tgggatttttatttgtacacaagca

SEQ ID NO: 1939 - DNA, 13 bp, Zea mays
tctgcagcttctg

SEQ ID NO: 1940 - DNA, 15 bp, Zea mays
tctgcttctgcttct

SEQ ID NO: 1941 - DNA, 23 bp, Zea mays
ggcagagagtgttcctgtaaagc

SEQ ID NO: 1942 - DNA, 28 bp, Zea mays
gatgagcaataaaatacccataacagat

SEQ ID NO: 1943 - DNA, 13 bp, Zea mays
agaaccaaaagcc

SEQ ID NO: 1944 - DNA, 15 bp, Zea mays
ccaaaggcctatttt

SEQ ID NO: 1945 - DNA, 24 bp, Zea mays
actgccatatgttttcctctcaca

SEQ ID NO: 1946 - DNA, 23 bp, Zea mays
ccatctagagtgaacgggacctt

SEQ ID NO: 1947 - DNA, 17 bp, Zea mays
agaagcttacaagttac

SEQ ID NO: 1948 - DNA, 17 bp, Zea mays
cagaagcttacaatatg

SEQ ID NO: 1949 - DNA, 23 bp, Zea mays
ccaagcagaagagagcagacaga

SEQ ID NO: 1950 - DNA, 20 bp, Zea mays
tccatcaccgtcttcatcca

SEQ ID NO: 1951 - DNA, 19 bp, Zea mays
tgccttcttatcatacgtt

SEQ ID NO: 1952 - DNA, 16 bp, Zea mays
tgccttcttatcttac

SEQ ID NO: 1953 - DNA, 20 bp, Zea mays
gcaccaccgaactgcactct

SEQ ID NO: 1954 - DNA, 20 bp, Zea mays
catgtttggcaacctttcca

SEQ ID NO: 1955 - DNA, 16 bp, Zea mays
tgctactgtcttcacc

SEQ ID NO: 1956 - DNA, 16 bp, Zea mays
tgctactgtctttacc

SEQ ID NO: 1957 - DNA, 19 bp, Zea mays
ccgggagatccagaacaca

SEQ ID NO: 1958 - DNA, 25 bp, Zea mays
caaacaaaagtgatagcaaaaatgc

SEQ ID NO: 1959 - DNA, 13 bp, Zea mays
catgcccagatcc

SEQ ID NO: 1960 - DNA, 13 bp, Zea mays
catgccccgatcc

SEQ ID NO: 1961 - DNA, 17 bp, Zea mays
cgggcacatgccaagct

SEQ ID NO: 1962 - DNA, 21 bp, Zea mays
cgaaccgacagaaacctctca

SEQ ID NO: 1963 - DNA, 13 bp, Zea mays
cacgacgtttttc

SEQ ID NO: 1964 - DNA, 13 bp, Zea mays
cacgacctttttc

SEQ ID NO: 1965 - DNA, 20 bp, Zea mays
caccggtgtctgatccttga

SEQ ID NO: 1966 - DNA, 20 bp, Zea mays
atggtcacccatgcatggta

SEQ ID NO: 1967 - DNA, 16 bp, Zea mays
cgctactatggccaag

SEQ ID NO: 1968 - DNA, 16 bp, Zea mays
ctactacggccaagca

SEQ ID NO: 1969 - DNA, 27 bp, Zea mays
cataatggagcaactatttgacagtgt

SEQ ID NO: 1970 - DNA, 25 bp, Zea mays
gaaaaatagcatggtacgacttcca

SEQ ID NO: 1971 - DNA, 16 bp, Zea mays
tcctgcatatgatttt

SEQ ID NO: 1972 - DNA, 15 bp, Zea mays
cctgcctatgatttt

SEQ ID NO: 1973 - DNA, 22 bp, Zea mays
gcgggaactcatctttcttctc

SEQ ID NO: 1974 - DNA, 19 bp, Zea mays
ttgacttggtcgggttcca

SEQ ID NO: 1975 - DNA, 14 bp, Zea mays
ctcctcgacatgct

SEQ ID NO: 1976 - DNA, 16 bp, Zea mays
ctcctcaacatgctta

SEQ ID NO: 1977 - DNA, 24 bp, Zea mays
gccaaatgttaatcaaaggtaggc

SEQ ID NO: 1978 - DNA, 28 bp, Zea mays
gccaagttcaaaagttagtacttacacc

SEQ ID NO: 1979 - DNA, 13 bp, Zea mays
ccgcccctgtgga

SEQ ID NO: 1980 - DNA, 14 bp, Zea mays
ccgcctctgtggaa

SEQ ID NO: 1981 - DNA, 24 bp, Zea mays
ttgtcgaatattcatcagcaggaa

SEQ ID NO: 1982 - DNA, 26 bp, Zea mays
ctagtgttatccttgactgcggtaaa

SEQ ID NO: 1983 - DNA, 16 bp, Zea mays
ccagtcttcagtcaag

SEQ ID NO: 1984 - DNA, 15 bp, Zea mays
agtctccagtcaagc

SEQ ID NO: 1985 - DNA, 28 bp, Zea mays
ctttacctcgttgacttcttaacaaatg

SEQ ID NO: 1986 - DNA, 20 bp, Zea mays
ggctgtttgcccaatttgtt

SEQ ID NO: 1987 - DNA, 16 bp, Zea mays
ctgagagatgactgcc

SEQ ID NO: 1988 - DNA, 16 bp, Zea mays
ctgagatgactgcctc

SEQ ID NO: 1989 - DNA, 19 bp, Zea mays
tcaattctgggtccacgca

SEQ ID NO: 1990 - DNA, 21 bp, Zea mays
tccatttcttgcttgccaaac

SEQ ID NO: 1991 - DNA, 15 bp, Zea mays
ccgggttccctagta

SEQ ID NO: 1992 - DNA, 15 bp, Zea mays
ttccccagtagcctg

SEQ ID NO: 1993 - DNA, 23 bp, Zea mays
ccctcaaggaattggcttatttg

SEQ ID NO: 1994 - DNA, 24 bp, Zea mays
gaaggtggatggttcagagagatt

SEQ ID NO: 1995 - DNA, 13 bp, Zea mays
tggtcgccttctt

SEQ ID NO: 1996 - DNA, 14 bp, Zea mays
tggtcaccttcttc

SEQ ID NO: 1997 - DNA, 23 bp, Zea mays
cgcttggtctggactctagaaaa

SEQ ID NO: 1998 - DNA, 27 bp, Zea mays
acagtcagtccctacagagtgtttagc

SEQ ID NO: 1999 - DNA, 16 bp, Zea mays
ttgtgaaggttgcctg

SEQ ID NO: 2000 - DNA, 15 bp, Zea mays
tttgtgaagattgcc

SEQ ID NO: 2001 - DNA, 24 bp, Zea mays
cctgatatagatgacgaccgacaa

SEQ ID NO: 2002 - DNA, 21 bp, Zea mays
tggaagagggatgctgaggat

SEQ ID NO: 2003 - DNA, 16 bp, Zea mays
tgggtaagtgcataac

SEQ ID NO: 2004 - DNA, 15 bp, Zea mays
tgggtaagcgcataa

SEQ ID NO: 2005 - DNA, 20 bp, Zea mays
ggacggcaatccagaagtga

SEQ ID NO: 2006 - DNA, 17 bp, Zea mays
gggtggccggacaacat

SEQ ID NO: 2007 - DNA, 14 bp, Zea mays
ccgtctgacccgag

SEQ ID NO: 2008 - DNA, 13 bp, Zea mays
ccgtccgacccga

SEQ ID NO: 2009 - DNA, 22 bp, Zea mays
cgtagttcacccacccaaagtt

SEQ ID NO: 2010 - DNA, 21 bp, Zea mays
cgcctgtgatttgaagtggaa

SEQ ID NO: 2011 - DNA, 16 bp, Zea mays
atcgtattccatcctt

SEQ ID NO: 2012 - DNA, 15 bp, Zea mays
tcgtactccatcctt

SEQ ID NO: 2013 - DNA, 28 bp, Zea mays
catgcaaattagcattactaaaatcaga

SEQ ID NO: 2014 - DNA, 24 bp, Zea mays
ggaaattttgcaagaccttttagg

SEQ ID NO: 2015 - DNA, 15 bp, Zea mays
tcctgcttgagttct

SEQ ID NO: 2016 - DNA, 16 bp, Zea mays
ctcctgtttgagttct

SEQ ID NO: 2017 - DNA, 18 bp, Zea mays
cggcctgcatcctttgtg

SEQ ID NO: 2018 - DNA, 25 bp, Zea mays
ggcagtgattactgttccagcttat

SEQ ID NO: 2019 - DNA, 14 bp, Zea mays
tgagcgtcattgaa

SEQ ID NO: 2020 - DNA, 15 bp, Zea mays
ctgagcatcattgaa

SEQ ID NO: 2021 - DNA, 20 bp, Zea mays
gcgcgcactactacctgtca

SEQ ID NO: 2022 - DNA, 26 bp, Zea mays
ggagaatatgcgaattaaaagggata

SEQ ID NO: 2023 - DNA, 16 bp, Zea mays
cgcttcctcttcagtt

SEQ ID NO: 2024 - DNA, 16 bp, Zea mays
ttcctcagttcgttcc

SEQ ID NO: 2025 - DNA, 21 bp, Zea mays
gctccagtctcagcagaacca

SEQ ID NO: 2026 - DNA, 21 bp, Zea mays
gctgtggttgtggtcggagta

SEQ ID NO: 2027 - DNA, 13 bp, Zea mays
cctccgctccatc

SEQ ID NO: 2028 - DNA, 15 bp, Zea mays
cctccactccatctt

SEQ ID NO: 2029 - DNA, 19 bp, Zea mays
gggagctccaacgttttcc

SEQ ID NO: 2030 - DNA, 20 bp, Zea mays
gcatagcacacacgccaaac

SEQ ID NO: 2031 - DNA, 15 bp, Zea mays
tgccacacaggtagt

SEQ ID NO: 2032 - DNA, 14 bp, Zea mays
tgccacacagctag

SEQ ID NO: 2033 - DNA, 21 bp, Zea mays
ggcctcagtgcagacaaaaca

SEQ ID NO: 2034 - DNA, 19 bp, Zea mays
ccccctggatgctgctcta

SEQ ID NO: 2035 - DNA, 15 bp, Zea mays
agggatagcaaatac

SEQ ID NO: 2036 - DNA, 17 bp, Zea mays
ctagggataacaaatac

SEQ ID NO: 2037 - DNA, 21 bp, Zea mays
ccattcgcctccatctatcgt

SEQ ID NO: 2038 - DNA, 21 bp, Zea mays
atggacgacgggtaaaggttt

SEQ ID NO: 2039 - DNA, 14 bp, Zea mays
ttgtcgcacgcacg

SEQ ID NO: 2040 - DNA, 15 bp, Zea mays
ttgtcccacgcacga

SEQ ID NO: 2041 - DNA, 22 bp, Zea mays
ccaacagtggtgccagtctaac

SEQ ID NO: 2042 - DNA, 22 bp, Zea mays
ctgcttaccatggacgcaacta

SEQ ID NO: 2043 - DNA, 16 bp, Zea mays
tgtgtgtgtgttccta

SEQ ID NO: 2044 - DNA, 16 bp, Zea mays
tgtgtgtgtgttctta

SEQ ID NO: 2045 - DNA, 23 bp, Zea mays
cgtttctgttgggtttcacaaaa

SEQ ID NO: 2046 - DNA, 24 bp, Zea mays
cagagaattgaacactcggaacaa

SEQ ID NO: 2047 - DNA, 16 bp, Zea mays
cggctaattaaacctt

SEQ ID NO: 2048 - DNA, 13 bp, Zea mays
cggctaatcaaac

SEQ ID NO: 2049 - DNA, 26 bp, Zea mays
tgatcaagatttcgtaggagtagcaa

SEQ ID NO: 2050 - DNA, 23 bp, Zea mays
aggtcgacaaggtcacaacaaac

SEQ ID NO: 2051 - DNA, 16 bp, Zea mays
agcatgcctacagtat

SEQ ID NO: 2052 - DNA, 15 bp, Zea mays
atgcccacagtatgt

SEQ ID NO: 2053 - DNA, 25 bp, Zea mays
aatagattatcagccgcagtaggaa

SEQ ID NO: 2054 - DNA, 24 bp, Zea mays
gctgaactttgacgttgtcttgtc

SEQ ID NO: 2055 - DNA, 14 bp, Zea mays
cgtcatcaagaaag

SEQ ID NO: 2056 - DNA, 15 bp, Zea mays
catcacgaaagaaat

SEQ ID NO: 2057 - DNA, 26 bp, Zea mays
gagctgagccgataataattaagtga

SEQ ID NO: 2058 - DNA, 27 bp, Zea mays
ccattttgttgtttcatgtaatctttg

SEQ ID NO: 2059 - DNA, 16 bp, Zea mays
cacttgagcatatgat

SEQ ID NO: 2060 - DNA, 17 bp, Zea mays
tgagcatacgataacta

SEQ ID NO: 2061 - DNA, 24 bp, Zea mays
caaaactggactaggactgatgga

SEQ ID NO: 2062 - DNA, 22 bp, Zea mays
tgaatgttggacccacgtgtaa

SEQ ID NO: 2063 - DNA, 16 bp, Zea mays
cagcaactaacaactg

SEQ ID NO: 2064 - DNA, 15 bp, Zea mays
agcaactaaaaactg

SEQ ID NO: 2065 - DNA, 27 bp, Zea mays
gaggatggtagacttgataggactgtt

SEQ ID NO: 2066 - DNA, 25 bp, Zea mays
gccaaagagataatgtttgattgct

SEQ ID NO: 2067 - DNA, 15 bp, Zea mays
tcaaggcatgggaag

SEQ ID NO: 2068 - DNA, 16 bp, Zea mays
cctactcaagacatgg

SEQ ID NO: 2069 - DNA, 23 bp, Zea mays
tagatgcactgcttgctgtccta

SEQ ID NO: 2070 - DNA, 24 bp, Zea mays
accctcagaagcaatctaaaacca

SEQ ID NO: 2071 - DNA, 20 bp, Zea mays
atttactgattgacgtactt

SEQ ID NO: 2072 - DNA, 20 bp, Zea mays
atttactgattgacatactt

SEQ ID NO: 2073 - DNA, 18 bp, Zea mays
gtcatgcgcgctgagttg

SEQ ID NO: 2074 - DNA, 19 bp, Zea mays
gcgactcttgctcgtccaa

SEQ ID NO: 2075 - DNA, 15 bp, Zea mays
tctgcatctgctggg

SEQ ID NO: 2076 - DNA, 15 bp, Zea mays
atctgctgggctaga

SEQ ID NO: 2077 - DNA, 19 bp, Zea mays
ccctgggaagcaatttcga

SEQ ID NO: 2078 - DNA, 25 bp, Zea mays
ttggagtctgtgacattcaatttca

SEQ ID NO: 2079 - DNA, 18 bp, Zea mays
attaacaggaaatgatgc

SEQ ID NO: 2080 - DNA, 16 bp, Zea mays
ctcattaacagaaaat

SEQ ID NO: 2081 - DNA, 22 bp, Zea mays
gcattggccattcttttaggaa

SEQ ID NO: 2082 - DNA, 20 bp, Zea mays
cactgcaccaggcctttgtt

SEQ ID NO: 2083 - DNA, 19 bp, Zea mays
acaaatactagagaattat

SEQ ID NO: 2084 - DNA, 17 bp, Zea mays
agtgatacacaaatatt

SEQ ID NO: 2085 - DNA, 24 bp, Zea mays
aacattgaaacgatgttcacaaca

SEQ ID NO: 2086 - DNA, 22 bp, Zea mays
tggtttccaatatggcactttg

SEQ ID NO: 2087 - DNA, 19 bp, Zea mays
cttcatatagatcattatc

SEQ ID NO: 2088 - DNA, 19 bp, Zea mays
acataacttcatataaatc

SEQ ID NO: 2089 - DNA, 27 bp, Zea mays
ctacagaagcattagatcaatcgaaca

SEQ ID NO: 2090 - DNA, 24 bp, Zea mays
gctgtgttgtagatcatgcatttg

SEQ ID NO: 2091 - DNA, 16 bp, Zea mays
aggactgatggtatct

SEQ ID NO: 2092 - DNA, 19 bp, Zea mays
aggactgatagtatcttaa

SEQ ID NO: 2093 - DNA, 22 bp, Zea mays
gcaggtaaaacaaccaggcaat

SEQ ID NO: 2094 - DNA, 22 bp, Zea mays
cgatttggatgatggatggtaa

SEQ ID NO: 2095 - DNA, 15 bp, Zea mays
cgaaggtgacaagag

SEQ ID NO: 2096 - DNA, 14 bp, Zea mays
cgaaggcgacaaga

SEQ ID NO: 2097 - DNA, 22 bp, Zea mays
gcccatcaaccaaactaccaaa

SEQ ID NO: 2098 - DNA, 22 bp, Zea mays
gcatatagggttggccaagtct

SEQ ID NO: 2099 - DNA, 18 bp, Zea mays
aaagagtgagaattgaat

SEQ ID NO: 2100 - DNA, 15 bp, Zea mays
aaagagtgaaaattg

SEQ ID NO: 2101 - DNA, 24 bp, Zea mays
actgtgctatacctaggcgaggaa

SEQ ID NO: 2102 - DNA, 25 bp, Zea mays
ccagaaggaggagtgttctcaaata

SEQ ID NO: 2103 - DNA, 15 bp, Zea mays
ttgttccccattaat

SEQ ID NO: 2104 - DNA, 14 bp, Zea mays
ccccatcaatgatt

SEQ ID NO: 2105 - DNA, 22 bp, Zea mays
gacgagatcagtcgaagcaaga

SEQ ID NO: 2106 - DNA, 17 bp, Zea mays
tccgacgcgatctgcaa

SEQ ID NO: 2107 - DNA, 14 bp, Zea mays
atggtggaaggctt

SEQ ID NO: 2108 - DNA, 15 bp, Zea mays
atggtagaaggcttc

SEQ ID NO: 2109 - DNA, 21 bp, Zea mays
tgcagtgtaggctgtggtgaa

SEQ ID NO: 2110 - DNA, 22 bp, Zea mays
tccaacccaatttatgcacaga

SEQ ID NO: 2111 - DNA, 14 bp, Zea mays
acgtctgaaactac

SEQ ID NO: 2112 - DNA, 14 bp, Zea mays
acgtcagaaactac

SEQ ID NO: 2113 - DNA, 27 bp, Zea mays
ctgattcataatcactctgtggacagt

SEQ ID NO: 2114 - DNA, 22 bp, Zea mays
ttgcacaattcgaaaccagttg

SEQ ID NO: 2115 - DNA, 15 bp, Zea mays
caggtctctctctgc

SEQ ID NO: 2116 - DNA, 15 bp, Zea mays
caggtctttctctgc

SEQ ID NO: 2117 - DNA, 23 bp, Zea mays
caacatctcgcaggaagaaagag

SEQ ID NO: 2118 - DNA, 18 bp, Zea mays
cgccagggtacgggaact

SEQ ID NO: 2119 - DNA, 16 bp, Zea mays
cctctatgagcgcagg

SEQ ID NO: 2120 - DNA, 15 bp, Zea mays
ctctacgagcgcagg

SEQ ID NO: 2121 - DNA, 29 bp, Zea mays
cttagattggattctctctttgttgttct

SEQ ID NO: 2122 - DNA, 22 bp, Zea mays
tacgaatggcatatggctgaag

SEQ ID NO: 2123 - DNA, 18 bp, Zea mays
tgcttaactaagaaaaga

SEQ ID NO: 2124 - DNA, 18 bp, Zea mays
cttaactaagcaaagaca

SEQ ID NO: 2125 - DNA, 20 bp, Zea mays
aggtcccgtgcttttggttt

SEQ ID NO: 2126 - DNA, 22 bp, Zea mays
tcgattcaacctgactcattgg

SEQ ID NO: 2127 - DNA, 16 bp, Zea mays
atgtcgtgtccaagaa

SEQ ID NO: 2128 - DNA, 16 bp, Zea mays
ctgatgtcgtctccaa

SEQ ID NO: 2129 - DNA, 21 bp, Zea mays
gcatggagcagtgaggttcct

SEQ ID NO: 2130 - DNA, 24 bp, Zea mays
acccctggatcattatcacatagc

SEQ ID NO: 2131 - DNA, 16 bp, Zea mays
caagaaccaacaatat

SEQ ID NO: 2132 - DNA, 16 bp, Zea mays
caagaaccaacattat

SEQ ID NO: 2133 - DNA, 26 bp, Zea mays
ccattaggaatcttgatgtacatggt

SEQ ID NO: 2134 - DNA, 21 bp, Zea mays
gttcttgttggcggtgtaacc

SEQ ID NO: 2135 - DNA, 16 bp, Zea mays
agtactagcaaagttc

SEQ ID NO: 2136 - DNA, 17 bp, Zea mays
cagtactaacaaagttc

SEQ ID NO: 2137 - DNA, 25 bp, Zea mays
cgttgcaggttccatattttaaact

SEQ ID NO: 2138 - DNA, 28 bp, Zea mays
ttgctattgaataccacagaattgtttt

SEQ ID NO: 2139 - DNA, 14 bp, Zea mays
atgatcgcattttt

SEQ ID NO: 2140 - DNA, 16 bp, Zea mays
tgatgatcacattttt

SEQ ID NO: 2141 - DNA, 22 bp, Zea mays
tttaaggacccctgcaagttga

SEQ ID NO: 2142 - DNA, 20 bp, Zea mays
ggtccatggattcgctaacg

SEQ ID NO: 2143 - DNA, 14 bp, Zea mays
tgcaactgggaagc

SEQ ID NO: 2144 - DNA, 13 bp, Zea mays
caactggaaagcc

SEQ ID NO: 2145 - DNA, 23 bp, Zea mays
catcctgtgctgtaacctgcata

SEQ ID NO: 2146 - DNA, 22 bp, Zea mays
ctgctgcagtttgttggatgat

SEQ ID NO: 2147 - DNA, 15 bp, Zea mays
aggtttggcacggga

SEQ ID NO: 2148 - DNA, 15 bp, Zea mays
aggtttgccacggga

SEQ ID NO: 2149 - DNA, 16 bp, Zea mays
cctgacggcgccatct

SEQ ID NO: 2150 - DNA, 16 bp, Zea mays
aggtggcgccagtgga

SEQ ID NO: 2151 - DNA, 13 bp, Zea mays
tcccgcgacctga

SEQ ID NO: 2152 - DNA, 14 bp, Zea mays
tgtcccgagacctg

SEQ ID NO: 2153 - DNA, 25 bp, Zea mays
tgttcaatcatctgttggctacatg

SEQ ID NO: 2154 - DNA, 25 bp, Zea mays
gctatttcttctgctgttgtgacaa

SEQ ID NO: 2155 - DNA, 13 bp, Zea mays
tgctgcggtttat

SEQ ID NO: 2156 - DNA, 16 bp, Zea mays
tgctgcagtttattag

SEQ ID NO: 2157 - DNA, 20 bp, Zea mays
agccccgacatcaagttcac

SEQ ID NO: 2158 - DNA, 25 bp, Zea mays
acctcaatcagttatcagtcgcatt

SEQ ID NO: 2159 - DNA, 13 bp, Zea mays
caggtcaatatcc

SEQ ID NO: 2160 - DNA, 13 bp, Zea mays
caggtcaagatcc

SEQ ID NO: 2161 - DNA, 23 bp, Zea mays
agtcagctcaaatgctcaaccat

SEQ ID NO: 2162 - DNA, 27 bp, Zea mays
gccacattctcctataatatcctgtca

SEQ ID NO: 2163 - DNA, 15 bp, Zea mays
cctgatgcgtcatac

SEQ ID NO: 2164 - DNA, 16 bp, Zea mays
tgatgcatcatactgg

SEQ ID NO: 2165 - DNA, 21 bp, Zea mays
gctccgcattgaaaagttctg

SEQ ID NO: 2166 - DNA, 21 bp, Zea mays
ttgtttgctgaggcagggtta

SEQ ID NO: 2167 - DNA, 15 bp, Zea mays
cctgacaggatatca

SEQ ID NO: 2168 - DNA, 15 bp, Zea mays
cctgacagggtatca

SEQ ID NO: 2169 - DNA, 19 bp, Zea mays
tcttgcccacgatgtcgtt

SEQ ID NO: 2170 - DNA, 19 bp, Zea mays
cgctcgcatccatgaagtt

SEQ ID NO: 2171 - DNA, 15 bp, Zea mays
catgttggagcctgg

SEQ ID NO: 2172 - DNA, 14 bp, Zea mays
catgtgggagcctg

SEQ ID NO: 2173 - DNA, 18 bp, Zea mays
acccctggctcgtttgct

SEQ ID NO: 2174 - DNA, 23 bp, Zea mays
gcgggcttactgttagaattggt

SEQ ID NO: 2175 - DNA, 14 bp, Zea mays
ctgccttctcttgc

SEQ ID NO: 2176 - DNA, 13 bp, Zea mays
ctgccatctcttg

SEQ ID NO: 2177 - DNA, 20 bp, Zea mays
ctgatttcgcgtcccttgag

SEQ ID NO: 2178 - DNA, 21 bp, Zea mays
ccccttgtatgcatgaaatcg

SEQ ID NO: 2179 - DNA, 16 bp, Zea mays
ttctcctgtggatgga

SEQ ID NO: 2180 - DNA, 15 bp, Zea mays
tctcccgtggatgga

SEQ ID NO: 2181 - DNA, 23 bp, Zea mays
tggttcgcattgttacattgtgt

SEQ ID NO: 2182 - DNA, 24 bp, Zea mays
tcaaacgcattcacatgttagaca

SEQ ID NO: 2183 - DNA, 16 bp, Zea mays
tgccaaaagattttat

SEQ ID NO: 2184 - DNA, 16 bp, Zea mays
tgccaaaagactttat

SEQ ID NO: 2185 - DNA, 25 bp, Zea mays
gctcaggtaacaattgtgctcagta

SEQ ID NO: 2186 - DNA, 17 bp, Zea mays
gcctccgacgcaattgg

SEQ ID NO: 2187 - DNA, 17 bp, Zea mays
caagtgcaaggtatatg

SEQ ID NO: 2188 - DNA, 16 bp, Zea mays
agtgcaaggtatgtct

SEQ ID NO: 2189 - DNA, 25 bp, Zea mays
caactcacctactcctgctcttgtt

SEQ ID NO: 2190 - DNA, 19 bp, Zea mays
gctagcagcgacgcattgt

SEQ ID NO: 2191 - DNA, 16 bp, Zea mays
tgctgagctatacgtc

SEQ ID NO: 2192 - DNA, 17 bp, Zea mays
tgctgaactatacgtcc

SEQ ID NO: 2193 - DNA, 25 bp, Zea mays
ccggatttgtgttgctttatttatg

SEQ ID NO: 2194 - DNA, 26 bp, Zea mays
taggtcactagttctccccttgagtt

SEQ ID NO: 2195 - DNA, 16 bp, Zea mays
ccgtgtatctaatcgt

SEQ ID NO: 2196 - DNA, 16 bp, Zea mays
ccgtgtaatcgttttg

SEQ ID NO: 2197 - DNA, 22 bp, Zea mays
gcagtgattgattgctttgctt

SEQ ID NO: 2198 - DNA, 20 bp, Zea mays
ggttcggatctgcaaaaagg

SEQ ID NO: 2199 - DNA, 13 bp, Zea mays
cctcgccatcgcg

SEQ ID NO: 2200 - DNA, 13 bp, Zea mays
cctcgccaacgcg

SEQ ID NO: 2201 - DNA, 23 bp, Zea mays
gtcggttgtattcaatccaagga

SEQ ID NO: 2202 - DNA, 24 bp, Zea mays
gcgcaagcaccatagtcctagtat

SEQ ID NO: 2203 - DNA, 15 bp, Zea mays
ctcagaacgaatcag

SEQ ID NO: 2204 - DNA, 15 bp, Zea mays
ctcagaacaaatcag

SEQ ID NO: 2205 - DNA, 26 bp, Zea mays
tctatgctattggtgctggtaatttc

SEQ ID NO: 2206 - DNA, 28 bp, Zea mays
ggtttctagcccatctttttattcttaa

SEQ ID NO: 2207 - DNA, 15 bp, Zea mays
ctccagtgtaatcaa

SEQ ID NO: 2208 - DNA, 16 bp, Zea mays
tctccattgtaatcaa

SEQ ID NO: 2209 - DNA, 20 bp, Zea mays
cggatggtgtcctggatctc

SEQ ID NO: 2210 - DNA, 17 bp, Zea mays
aggcgttcggcgacatc

SEQ ID NO: 2211 - DNA, 15 bp, Zea mays
tactccctcatcctc

SEQ ID NO: 2212 - DNA, 14 bp, Zea mays
cctactcgctcatc

SEQ ID NO: 2213 - DNA, 25 bp, Zea mays
aggtttaagccattgtcacttgtct

SEQ ID NO: 2214 - DNA, 20 bp, Zea mays
gcactcagcacctgccattt

SEQ ID NO: 2215 - DNA, 15 bp, Zea mays
tgttccgtaaaagga

SEQ ID NO: 2216 - DNA, 16 bp, Zea mays
tgtgttccttaaaagg

SEQ ID NO: 2217 - DNA, 28 bp, Zea mays
ggtttctagcccatctttttattcttaa

SEQ ID NO: 2218 - DNA, 26 bp, Zea mays
tctatgctattggtgctggtaatttc

SEQ ID NO: 2219 - DNA, 16 bp, Zea mays
tctccattgtaatcaa

SEQ ID NO: 2220 - DNA, 15 bp, Zea mays
ctccagtgtaatcaa

SEQ ID NO: 2221 - DNA, 25 bp, Zea mays
atctctgttctgccatctttgtttt

SEQ ID NO: 2222 - DNA, 25 bp, Zea mays
gagagatgcactgtcaccttagctt

SEQ ID NO: 2223 - DNA, 15 bp, Zea mays
aagcacgtaatttga

SEQ ID NO: 2224 - DNA, 14 bp, Zea mays
caagcacataattt

SEQ ID NO: 2225 - DNA, 29 bp, Zea mays
ggaaaattgtagtacttcagaacgagtct

SEQ ID NO: 2226 - DNA, 21 bp, Zea mays
ataaagtgctgcagcctgcat

SEQ ID NO: 2227 - DNA, 16 bp, Zea mays
tgcaaacacatattag

SEQ ID NO: 2228 - DNA, 15 bp, Zea mays
caaacgcatattagc

SEQ ID NO: 2229 - DNA, 25 bp, Zea mays
caggacacaatcccaaggttagtaa

SEQ ID NO: 2230 - DNA, 21 bp, Zea mays
ggacaccctagcttggtttgc

SEQ ID NO: 2231 - DNA, 13 bp, Zea mays
cagccaagccaac

SEQ ID NO: 2232 - DNA, 13 bp, Zea mays
ccagccaaaccaa

SEQ ID NO: 2233 - DNA, 20 bp, Zea mays
ctgatttcgcgtcccttgag

SEQ ID NO: 2234 - DNA, 21 bp, Zea mays
ccccttgtatgcatgaaatcg

SEQ ID NO: 2235 - DNA, 16 bp, Zea mays
ttctcctgtggatgga

SEQ ID NO: 2236 - DNA, 15 bp, Zea mays
tctcccgtggatgga

SEQ ID NO: 2237 - DNA, 28 bp, Zea mays
tcatatgcacaatctctcttttcttaca

SEQ ID NO: 2238 - DNA, 25 bp, Zea mays
cctgtcaagaagagacccacattta

SEQ ID NO: 2239 - DNA, 15 bp, Zea mays
tgcaatgcttttagc

SEQ ID NO: 2240 - DNA, 13 bp, Zea mays
agctgcaactttt

SEQ ID NO: 2241 - DNA, 21 bp, Zea mays
tcttggcattgggtcaaattg

SEQ ID NO: 2242 - DNA, 26 bp, Zea mays
ctacgattcgcagcatatacaacttt

SEQ ID NO: 2243 - DNA, 15 bp, Zea mays
attccgtgctgcacc

SEQ ID NO: 2244 - DNA, 15 bp, Zea mays
attccctgctgcacc

SEQ ID NO: 2245 - DNA, 25 bp, Zea mays
ctgaggaagttttggaaacaagaat

SEQ ID NO: 2246 - DNA, 24 bp, Zea mays
actcaatggtcagttaccctctga

SEQ ID NO: 2247 - DNA, 15 bp, Zea mays
cgaaagcagtggact

SEQ ID NO: 2248 - DNA, 15 bp, Zea mays
atcgaaagcaatgga

SEQ ID NO: 2249 - DNA, 19 bp, Zea mays
gctgctggcagcactgttg

SEQ ID NO: 2250 - DNA, 16 bp, Zea mays
cggcggcgccctacta

SEQ ID NO: 2251 - DNA, 14 bp, Zea mays
cggctggtacatgg

SEQ ID NO: 2252 - DNA, 13 bp, Zea mays
cggctggaacatg

SEQ ID NO: 2253 - DNA, 25 bp, Zea mays
tgggaaggctaatttaccagttacc

SEQ ID NO: 2254 - DNA, 25 bp, Zea mays
cagtgagagaagaaggctaaaacca

SEQ ID NO: 2255 - DNA, 18 bp, Zea mays
aaagctcaaactattacc

SEQ ID NO: 2256 - DNA, 16 bp, Zea mays
aagctcgaactattac

SEQ ID NO: 2257 - DNA, 21 bp, Zea mays
gtagccaatggccaagtgttg

SEQ ID NO: 2258 - DNA, 24 bp, Zea mays
cctcactgtgcattacctagcaaa

SEQ ID NO: 2259 - DNA, 14 bp, Zea mays
cttgtgccgatgct

SEQ ID NO: 2260 - DNA, 14 bp, Zea mays
ccttgtgcccatgc

SEQ ID NO: 2261 - DNA, 17 bp, Zea mays
ggcggccttcagcaaag

SEQ ID NO: 2262 - DNA, 23 bp, Zea mays
ttctacttcgatgaggccttgtg

SEQ ID NO: 2263 - DNA, 15 bp, Zea mays
acacccttcgtttga

SEQ ID NO: 2264 - DNA, 15 bp, Zea mays
cacccttcctttgac

SEQ ID NO: 2265 - DNA, 25 bp, Zea mays
tgcttctgttcagctccacatatag

SEQ ID NO: 2266 - DNA, 24 bp, Zea mays
cgattccaagaacagcataacaag

SEQ ID NO: 2267 - DNA, 15 bp, Zea mays
tcgaacgttggctca

SEQ ID NO: 2268 - DNA, 15 bp, Zea mays
ctcgaaccttggctc

SEQ ID NO: 2269 - DNA, 25 bp, Zea mays
gcaacatgcaacaaactaattgaag

SEQ ID NO: 2270 - DNA, 20 bp, Zea mays
gtgaaccagaaggcgctttt

SEQ ID NO: 2271 - DNA, 14 bp, Zea mays
atctcggagtcgcc

SEQ ID NO: 2272 - DNA, 16 bp, Zea mays
atcgatctcagagtcg

SEQ ID NO: 2273 - DNA, 24 bp, Zea mays
aaactgaagaagaggcagcagaag

SEQ ID NO: 2274 - DNA, 19 bp, Zea mays
gcatgaacaccccgaagct

SEQ ID NO: 2275 - DNA, 16 bp, Zea mays
atgacattgcagcgat

SEQ ID NO: 2276 - DNA, 18 bp, Zea mays
cttatgacatcgcagcga

SEQ ID NO: 2277 - DNA, 25 bp, Zea mays
cgatgaggatataactgctgagaca

SEQ ID NO: 2278 - DNA, 25 bp, Zea mays
atcatgacaaccttttcagacattg

SEQ ID NO: 2279 - DNA, 14 bp, Zea mays
agtgtggagaaact

SEQ ID NO: 2280 - DNA, 14 bp, Zea mays
agtgtcgagaaact

SEQ ID NO: 2281 - DNA, 21 bp, Zea mays
ctttggaagggcactctgaaa

SEQ ID NO: 2282 - DNA, 25 bp, Zea mays
cttgttggtccatcatctcttgtta

SEQ ID NO: 2283 - DNA, 14 bp, Zea mays
aatggcaaatattg

SEQ ID NO: 2284 - DNA, 14 bp, Zea mays
tggcaaagattgac

SEQ ID NO: 2285 - DNA, 20 bp, Zea mays
tcgacttgcgactccatgaa

SEQ ID NO: 2286 - DNA, 17 bp, Zea mays
tccgtcgctgcaacgaa

SEQ ID NO: 2287 - DNA, 13 bp, Zea mays
aagcccggacttt

SEQ ID NO: 2288 - DNA, 13 bp, Zea mays
aagcccagacttt

SEQ ID NO: 2289 - DNA, 24 bp, Zea mays
ctggtaaatttgggaaaggagatg

SEQ ID NO: 2290 - DNA, 23 bp, Zea mays
tgatgtcattgctgttgcttagg

SEQ ID NO: 2291 - DNA, 16 bp, Zea mays
aaattcctggatcacc

SEQ ID NO: 2292 - DNA, 17 bp, Zea mays
caaattcttggatcacc

SEQ ID NO: 2293 - DNA, 30 bp, Zea mays
acagacaatacatatttcagagatgaggtt

SEQ ID NO: 2294 - DNA, 25 bp, Zea mays
acaaacaagggactattcgatatgg

SEQ ID NO: 2295 - DNA, 18 bp, Zea mays
cgatagaaagtaaacatg

SEQ ID NO: 2296 - DNA, 17 bp, Zea mays
cgataggaagtaaacat

SEQ ID NO: 2297 - DNA, 17 bp, Zea mays
ggcgcgtcgtcaaaggt

SEQ ID NO: 2298 - DNA, 20 bp, Zea mays
caaccgatggatggatggat

SEQ ID NO: 2299 - DNA, 16 bp, Zea mays
tgttacgtaccggtcg

SEQ ID NO: 2300 - DNA, 15 bp, Zea mays
tgttaccggtcgatc

SEQ ID NO: 2301 - DNA, 21 bp, Zea mays
catcctgccatgatcatgtca

SEQ ID NO: 2302 - DNA, 25 bp, Zea mays
acttgtggttcttgatttcgtcact

SEQ ID NO: 2303 - DNA, 13 bp, Zea mays
cagccgtctgcca

SEQ ID NO: 2304 - DNA, 13 bp, Zea mays
tcccagccttctg

SEQ ID NO: 2305 - DNA, 25 bp, Zea mays
caactcacctactcctgctcttgtt

SEQ ID NO: 2306 - DNA, 19 bp, Zea mays
gctagcagcgacgcattgt

SEQ ID NO: 2307 - DNA, 16 bp, Zea mays
tgctgagctatacgtc

SEQ ID NO: 2308 - DNA, 17 bp, Zea mays
tgctgaactatacgtcc

SEQ ID NO: 2309 - DNA, 22 bp, Zea mays
tgaacccatggatgcagtactg

SEQ ID NO: 2310 - DNA, 21 bp, Zea mays
ccaacagttgctgcatcatca

SEQ ID NO: 2311 - DNA, 14 bp, Zea mays
cgctaacaagttgg

SEQ ID NO: 2312 - DNA, 14 bp, Zea mays
acgctagcaagttg

SEQ ID NO: 2313 - DNA, 25 bp, Zea mays
ttgttggtgctgcattctagataga

SEQ ID NO: 2314 - DNA, 19 bp, Zea mays
acgcgatggcatgtcaact

SEQ ID NO: 2315 - DNA, 15 bp, Zea mays
ttgtaccgaataatg

SEQ ID NO: 2316 - DNA, 16 bp, Zea mays
tgttgtaccaaataat

SEQ ID NO: 2317 - DNA, 25 bp, Zea mays
ggtttgcagaattgatggtagtgtt

SEQ ID NO: 2318 - DNA, 26 bp, Zea mays
gagtaatatattggcacaggctagca

SEQ ID NO: 2319 - DNA, 15 bp, Zea mays
tgttacctgccgccg

SEQ ID NO: 2320 - DNA, 13 bp, Zea mays
acctgtcgccgcc

SEQ ID NO: 2321 - DNA, 18 bp, Zea mays
acccctacgggcctatgc

SEQ ID NO: 2322 - DNA, 20 bp, Zea mays
gggctggagcaatctgtttg

SEQ ID NO: 2323 - DNA, 14 bp, Zea mays
ccttcggagaaagt

SEQ ID NO: 2324 - DNA, 15 bp, Zea mays
ccttcagagaaagtc

SEQ ID NO: 2325 - DNA, 25 bp, Zea mays
tcctagtctagttcttctgcgcaat

SEQ ID NO: 2326 - DNA, 21 bp, Zea mays
gcgttcagccattgttcatgt

SEQ ID NO: 2327 - DNA, 14 bp, Zea mays
agcgtctgtctcac

SEQ ID NO: 2328 - DNA, 15 bp, Zea mays
cagcgtatgtctcac

SEQ ID NO: 2329 - DNA, 24 bp, Zea mays
ttggttaatcctgcagaaatgttg

SEQ ID NO: 2330 - DNA, 21 bp, Zea mays
tgcggttgcatcagttctttc

SEQ ID NO: 2331 - DNA, 15 bp, Zea mays
atctcggtgttttct

SEQ ID NO: 2332 - DNA, 16 bp, Zea mays
cgtggatctcagtgtt

SEQ ID NO: 2333 - DNA, 26 bp, Zea mays
gcagacttgatagagaaatgctacga

SEQ ID NO: 2334 - DNA, 25 bp, Zea mays
tgctctgctgtaagtgttgtctttc

SEQ ID NO: 2335 - DNA, 16 bp, Zea mays
ttgaaggtcacaatat

SEQ ID NO: 2336 - DNA, 17 bp, Zea mays
ttgaagatcacaatatt

SEQ ID NO: 2337 - DNA, 21 bp, Zea mays
acaattggcaccagaccattc

SEQ ID NO: 2338 - DNA, 20 bp, Zea mays
agcttgccatcgacctgaac

SEQ ID NO: 2339 - DNA, 15 bp, Zea mays
tgatggcgtagcgag

SEQ ID NO: 2340 - DNA, 15 bp, Zea mays
tgatggcatagcgag

SEQ ID NO: 2341 - DNA, 24 bp, Zea mays
gcatgtgtctgtatgcattatgca

SEQ ID NO: 2342 - DNA, 17 bp, Zea mays
ccaccaccgcagcattg

SEQ ID NO: 2343 - DNA, 16 bp, Zea mays
aggtggtcatcggtag

SEQ ID NO: 2344 - DNA, 15 bp, Zea mays
tggtcgtcggtagat

SEQ ID NO: 2345 - DNA, 21 bp, Zea mays
caccgcagtttagtcgagcaa

SEQ ID NO: 2346 - DNA, 25 bp, Zea mays
aggccgaaacttattggctatgtat

SEQ ID NO: 2347 - DNA, 16 bp, Zea mays
cctatggtgacatcat

SEQ ID NO: 2348 - DNA, 14 bp, Zea mays
tggtgccatcatag

SEQ ID NO: 2349 - DNA, 23 bp, Zea mays
tcgtctggtaagctcacatgcta

SEQ ID NO: 2350 - DNA, 23 bp, Zea mays
cgggtaatgaacacacgaaatct

SEQ ID NO: 2351 - DNA, 15 bp, Zea mays
accacactcacatgc

SEQ ID NO: 2352 - DNA, 16 bp, Zea mays
ttggaccactcacatg

SEQ ID NO: 2353 - DNA, 25 bp, Zea mays
tttttggtgagctattcctctatgc

SEQ ID NO: 2354 - DNA, 20 bp, Zea mays
ggctcccaagagggcctata

SEQ ID NO: 2355 - DNA, 16 bp, Zea mays
aggtgtaggataattg

SEQ ID NO: 2356 - DNA, 16 bp, Zea mays
aggtgtaggttaattg

SEQ ID NO: 2357 - DNA, 24 bp, Zea mays
ggttatgacatgcttggtcgtaca

SEQ ID NO: 2358 - DNA, 21 bp, Zea mays
aagagcgtccaacttcaatgc

SEQ ID NO: 2359 - DNA, 16 bp, Zea mays
ctgctcagttgttctg

SEQ ID NO: 2360 - DNA, 15 bp, Zea mays
tgctcggttgttctg

SEQ ID NO: 2361 - DNA, 25 bp, Zea mays
gtgggagaagaatggtgttaacagt

SEQ ID NO: 2362 - DNA, 22 bp, Zea mays
acccaatttcgagaggaactca

SEQ ID NO: 2363 - DNA, 15 bp, Zea mays
ctgcaatacaggcac

SEQ ID NO: 2364 - DNA, 14 bp, Zea mays
tgcaacacaggcac

SEQ ID NO: 2365 - DNA, 25 bp, Zea mays
cacttgtcccatatatttggtggtt

SEQ ID NO: 2366 - DNA, 22 bp, Zea mays
tgtggtgaggttgcagttttgt

SEQ ID NO: 2367 - DNA, 16 bp, Zea mays
aacacctgaatcatag

SEQ ID NO: 2368 - DNA, 15 bp, Zea mays
cgaacacctaaatca

SEQ ID NO: 2369 - DNA, 22 bp, Zea mays
acccaatttcgagaggaactca

SEQ ID NO: 2370 - DNA, 25 bp, Zea mays
gtgggagaagaatggtgttaacagt

SEQ ID NO: 2371 - DNA, 14 bp, Zea mays
tgcaacacaggcac

SEQ ID NO: 2372 - DNA, 15 bp, Zea mays
ctgcaatacaggcac

SEQ ID NO: 2373 - DNA, 19 bp, Zea mays
cctccctggcatcaaggtt

SEQ ID NO: 2374 - DNA, 24 bp, Zea mays
ggtctccttatcagtgccaacaac

SEQ ID NO: 2375 - DNA, 16 bp, Zea mays
caagggtaccattgag

SEQ ID NO: 2376 - DNA, 14 bp, Zea mays
acaagggcaccatt

SEQ ID NO: 2377 - DNA, 22 bp, Zea mays
ccagacgaactgtggagctctt

SEQ ID NO: 2378 - DNA, 17 bp, Zea mays
tgtggcgctgcaacgat

SEQ ID NO: 2379 - DNA, 13 bp, Zea mays
cgaacgcgaagct

SEQ ID NO: 2380 - DNA, 14 bp, Zea mays
cacgaacacgaagc

SEQ ID NO: 2381 - DNA, 22 bp, Zea mays
gctcagatctcgctgtgattga

SEQ ID NO: 2382 - DNA, 24 bp, Zea mays
agagtgttctcccgtccatatagc

SEQ ID NO: 2383 - DNA, 14 bp, Zea mays
atgctcaggctaac

SEQ ID NO: 2384 - DNA, 15 bp, Zea mays
tgggtatgctaaggc

SEQ ID NO: 2385 - DNA, 19 bp, Zea mays
cctccctggcatcaaggtt

SEQ ID NO: 2386 - DNA, 24 bp, Zea mays
ggtctccttatcagtgccaacaac

SEQ ID NO: 2387 - DNA, 16 bp, Zea mays
caagggtaccattgag

SEQ ID NO: 2388 - DNA, 14 bp, Zea mays
acaagggcaccatt

SEQ ID NO: 2389 - DNA, 22 bp, Zea mays
gctcagatctcgctgtgattga

SEQ ID NO: 2390 - DNA, 24 bp, Zea mays
agagtgttctcccgtccatatagc

SEQ ID NO: 2391 - DNA, 14 bp, Zea mays
atgctcaggctaac

SEQ ID NO: 2392 - DNA, 15 bp, Zea mays
tgggtatgctaaggc

SEQ ID NO: 2393 - DNA, 23 bp, Zea mays
atgtcgagaacgttgaggagaac

SEQ ID NO: 2394 - DNA, 22 bp, Zea mays
ggatcacaccgctgatgtactg

SEQ ID NO: 2395 - DNA, 16 bp, Zea mays
tcctattctgttgccc

SEQ ID NO: 2396 - DNA, 15 bp, Zea mays
ttctgctgccctggt

SEQ ID NO: 2397 - DNA, 22 bp, Zea mays
gctcagatctcgctgtgattga

SEQ ID NO: 2398 - DNA, 24 bp, Zea mays
agagtgttctcccgtccatatagc

SEQ ID NO: 2399 - DNA, 14 bp, Zea mays
atgctcaggctaac

SEQ ID NO: 2400 - DNA, 15 bp, Zea mays
tgggtatgctaaggc

SEQ ID NO: 2401 - DNA, 18 bp, Zea mays
agcctcgcggagcttctc

SEQ ID NO: 2402 - DNA, 24 bp, Zea mays
acgtatggaacgcttcattctctt

SEQ ID NO: 2403 - DNA, 16 bp, Zea mays
caatcacgtgataatg

SEQ ID NO: 2404 - DNA, 16 bp, Zea mays
tcaatcacgtgctaat

SEQ ID NO: 2405 - DNA, 19 bp, Zea mays
cctccctggcatcaaggtt

SEQ ID NO: 2406 - DNA, 24 bp, Zea mays
ggtctccttatcagtgccaacaac

SEQ ID NO: 2407 - DNA, 16 bp, Zea mays
caagggtaccattgag

SEQ ID NO: 2408 - DNA, 14 bp, Zea mays
acaagggcaccatt

SEQ ID NO: 2409 - DNA, 16 bp, Zea mays
ctgagccgctgccgtt

SEQ ID NO: 2410 - DNA, 20 bp, Zea mays
tgcgacattgtggctttcaa

SEQ ID NO: 2411 - DNA, 15 bp, Zea mays
cccaatctcagaaac

SEQ ID NO: 2412 - DNA, 15 bp, Zea mays
cccaaactcagaaac

SEQ ID NO: 2413 - DNA, 19 bp, Zea mays
cctccctggcatcaaggtt

SEQ ID NO: 2414 - DNA, 24 bp, Zea mays
ggtctccttatcagtgccaacaac

SEQ ID NO: 2415 - DNA, 16 bp, Zea mays
caagggtaccattgag

SEQ ID NO: 2416 - DNA, 14 bp, Zea mays
acaagggcaccatt

SEQ ID NO: 2417 - DNA, 24 bp, Zea mays
agagtgttctcccgtccatatagc

SEQ ID NO: 2418 - DNA, 22 bp, Zea mays
gctcagatctcgctgtgattga

SEQ ID NO: 2419 - DNA, 15 bp, Zea mays
tgggtatgctaaggc

SEQ ID NO: 2420 - DNA, 14 bp, Zea mays
atgctcaggctaac

SEQ ID NO: 2421 - DNA, 25 bp, Zea mays
gctgctcttcgtgagaattatgaaa

SEQ ID NO: 2422 - DNA, 21 bp, Zea mays
ccacgctactttgccaattca

SEQ ID NO: 2423 - DNA, 14 bp, Zea mays
tggcatcgcctgat

SEQ ID NO: 2424 - DNA, 15 bp, Zea mays
ttggcatcacctgat

SEQ ID NO: 2425 - DNA, 22 bp, Zea mays
tgaacccatggatgcagtactg

SEQ ID NO: 2426 - DNA, 21 bp, Zea mays
caacagttgctgcagcatcag

SEQ ID NO: 2427 - DNA, 14 bp, Zea mays
cgctaacaagttgg

SEQ ID NO: 2428 - DNA, 14 bp, Zea mays
acgctagcaagttg

SEQ ID NO: 2429 - DNA, 24 bp, Zea mays
gtcattgtaaacctcatcgttgga

SEQ ID NO: 2430 - DNA, 24 bp, Zea mays
cctagtgctgtccatacacacaca

SEQ ID NO: 2431 - DNA, 15 bp, Zea mays
ctcagctacaggtgc

SEQ ID NO: 2432 - DNA, 14 bp, Zea mays
tcagccacaggtgc

SEQ ID NO: 2433 - DNA, 19 bp, Zea mays
aaacctgcgagccatgttg

SEQ ID NO: 2434 - DNA, 21 bp, Zea mays
agggtcgatttccagttccaa

SEQ ID NO: 2435 - DNA, 15 bp, Zea mays
tcgcagaccactagt

SEQ ID NO: 2436 - DNA, 14 bp, Zea mays
cgcagacaactagt

What is claimed is:

1. A method of identifying oil-associated QTLs in maize comprising
   (a) establishing a population of maize plants derived from the Illinois high oil line and/or the Illinois low oil line,
   (b) selecting a set of oil informative allelic polymorphic markers from at least 40 loci from the set of polymorphic markers listed in Table 3,
   (c) using said markers to identify oil-associated QTLs in said maize plants.

* * * * *